United States Patent 12,569,549 (FLAVIVIRUS VACCINE) - sequence listing, part 9

SEQ ID NO: 5862 - RNA, 9879 nt, synthetic construct
  misc_feature 1..9879: note = derived and/or modified CDS sequence (wt) from DENV-1__GQ199787__SS-prME
  source 1..9879: mol_type = other RNA
tctgtgaccatgctgctcatgctggtgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgatgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaagtcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactgagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtgcagaacacaacctttatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattctacttaaagcaactctgctagcagtttcaggggtgtatccattatcaataccagcgaccctttttttgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaagacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaactcgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaacgaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctaggaaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaatgagggtgatcccgaaggggcactctggtga

SEQ ID NO: 5863 - RNA, 9879 nt, synthetic construct
  misc_feature 1..9879: note = derived and/or modified CDS sequence (wt) from DENV-1__GQ199788__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgtttagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcgactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggccaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattgttccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttctccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtagaggtccaagatgatggaaccatgaagataaaggatgaagagagagatgacacgctaaccattctccttaaagcaactctgctagcagtctcaggggtatacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttgacaataatggacctacatccaggatcggggaaaacaagaagatatcttccagccatagtccgtgaggccataaaaaggaagctgcgcacattaattctggctcccacaagagttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtatatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacgtactcagacccactggccctgcgcgagtttaaagagtttgcagcaggaagaagaagcgtctcaggtgatctaatattagaaatagggaaacttccacaacacctgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttagggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccaggagagttcttgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagttgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaacgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggtgcactctggtga

SEQ ID NO: 5864 - RNA, 9879 nt, synthetic construct
  misc_feature 1..9879: note = derived and/or modified CDS sequence (wt) from DENV-1__GQ199789__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaattgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagtccaacatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggacgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaacatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaactccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggagtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagttcgtgaggccataaaaaggaagctgcgcacattaattctggctcccacaagggttgtcgcttccgaaatggcagaggcgctcaagggaatgccaataaggtaccaaacaacagcagtgaagggtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatattggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttggtactatgcacatcacaaatcctcttgatgcggactacatgggccttgtgtgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatagaagcccagctgataagacagatggagtctgaggaaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgccaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5865 - RNA, 9879 nt, synthetic construct
  misc_feature 1..9879: note = derived and/or modified CDS sequence (wt) from DENV-1__GQ199790__SS-prME
  source 1..9879: mol_type = other RNA
tctgtgactatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgttctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgactaaactggaaggaaagatagttcaatatgaaaacttgaaatattcagtaatagtcaccgtccacactggagaccagcaccaggtgggaaatgaaagcacagaacatgggacaactgcaactataacaccccaagctcccacgtcggaaatacagctgaccgactacggagctctcacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagacttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgaccctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatctttggaaccgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaggttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaatttacagtggttgtaggagatgtagttgggatcttggctcaagggaaaaaaatgatcaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcccacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaattacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcgatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactagccatgtttcttatagcagaaaacaaaatctggggaaggaaaagttggcccctcaatgaaggaattatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaacatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtacttatgtaccaagggaagagactagaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcggtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgcgtcattctagcaggaccgatgccagtaactgtagccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggatcatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagtgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgctgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacagctaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccttacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttactaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtagtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccagaattactgacatcatggagcccgaacatgccctactggctacgtcaatctttaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgaaggaatctttttacccagcgaattggagacccaaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcttccaacatacaagtggccataaaccaagtgagaagactaattgggaatgagaattatctagattacatgacatcaatgaagagattcaagaacgagggtgatcccgaaggggcactctggtga

SEQ ID NO: 5866 - RNA, 9879 nt, synthetic construct
  misc_feature 1..9879: note = derived and/or modified CDS sequence (wt) from DENV-1__GQ199791__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggtgagcaccgacgagacaaacgttccgtcgcactggccccacacgtgggacttggtttggaaacaagaaccgaaacgtggatgtcctctgaaggcgcttggaaacagatacaaagagtggaaacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaaccgcaactataacacctcaagctcccacatcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacatctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatcccttttttgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaagtgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaaacaaatatcaaatgaactgaaccacatcttacttgaaaatgacatgaaattcacagtggttgtaggagatgtagtcgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagagagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgcacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctggcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgtacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagtatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactgaaagatggcccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattaccagacaccatagaaacgttgatgctcctagctttgatagctgtgttgactggtggagtgacgctgttcttcctatcaggaaggggcctagggaaaacatctatcggcgtactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaatattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaggtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatctgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagctccacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagatctgagactagccgctaatgctatctgttcagccgttccagttgattgggtcccaaccagtcgcaccacctggtcgatccatgcccaccaccaatggatgacaacagaagacatgttgtcagtgtggaacagggtttggatagaggaaaacccatggatggaggacaaaacccatgtatccagttggggagatgttccatatctagggaaaagggaagatcagtggtgtggatccctgataggcttaacagcaagggccacctgggcctccaacatacaggtggccataaaccaagtgagaagactaattgggaatgagaattatctagattacatgacatcaatgaagagattcaagaacgagggtgatcccgaaggggcattctggtga

SEQ ID NO: 5867 - RNA, 9879 nt, synthetic construct
  misc_feature 1..9879: note = derived and/or modified CDS sequence (wt) from DENV-1__GQ199792__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgccctcgaattactgaggcggaaccagatgacgttgattgttggtgcaatgccacagacgcatgggtgacctatggaacatgttcccaaactggcgagcaccgacgagacaaacgttccgtcgcactggccccacacgtgggacttggcttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggcttttcggaaaaggaagcctaataacgtgtgctaagtttaagtgtgtgacaaaactggaaggaaaaatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacatgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcctaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagaaaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaatcctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggacgtcatccccatggtcacacaaatagccatgactgacactacaccctttgggcaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccaggtgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagaccaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcctgaaggggcactctggtga

SEQ ID NO: 5868 - RNA, 9879 nt, synthetic construct
  misc_feature 1..9879: note = derived and/or modified CDS sequence (wt) from DENV-1__GQ199793__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggtgcttggaaacagatacaaagagtggagacttgggccctgagacacccaggattcacggtgatagccctttttttagcacatgccataggaacatccatcacccagaaggggattattttcattttgttaatgctggtaacaccatccatggccatgcgatgcgtgggaataggcagcagggacttcgtggaaggactgtcaggagcaacctgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggttgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacacgggacaactgcaactataacacctcaagctcccacgtcggaaatacagctgaccgactacggagctcttacattggactgctcacccagaacaggactagactttaatgaaatggtgttgttgacaatgaaagaaaaatcatggctagtccacaaacaatggtttctagacctaccactgccttggacttcaggagctacaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtaatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccaccttttggtgagagttacatcgtgataggagcaggtgaaaaagctttgaaactaagctggttcaagaaaggaagtagcatagggaaaatgtttgaggcaactgccagaggagcacggagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaaatgtgtgaccaccggctaatgtcagctgccatcaaggacagcaaggcagttcatgctgacatggggtactggatagaaagtgaaaagaacgagacctggaagctggcaagagcctctttcatagaagttaaaacatgtatttggccaaaatcccacactctatggagcaacggagttctggaaagtgaaatgataattccaaagatctatggaggaccaatatctcagcacaactacagaccaggatatttcacacaaacggcagggccatggcacctaggtaagttggaactggattttgatttgtgtgagggtaccacagttgttgtggatgaacattgtggaaaccgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgttgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaagccactaaccatgtttctcataacagaaaacaaaatctggggaaggaaaagttggcccctcaatgaaggaatcatggctgttggagtggtcagtatcctactaagttcactcctcaaaaatgatgtgccgctagctgggccactaatagctggaggcatgctaatagcatgttatgtcatatctggaagctcagccgacttatcactagagaaagcggctgaggtctcctgggaagaagaagcagaacactctggtgcctcacacaatatattagtggaagtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacgcgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctacgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaactcgagtgggcatgggtgaagcagctgcgatcttcatgacagccactcccccaggatcagtggaggcctttccacagagcaatgcagttatccaagatgaggaaagagacattcctgagagatcatggaactcaggacatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagctgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctctaaacaacgacgaagatcacgctcactggacagaagcaaaaatgctccttgataatataaacacaccagaagggattatcccagctctcttcgagccagagagggaaaagagtgcagcaatagacggggaatacagactgcggggtgaagcaaggaagacgtttgtggagctcatgagaaggggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttgcatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactacaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacatcttcagaggaagttatctagcaggagcaggtctggccttctcattaatgaaatctttaggaggaggtaggagaggcacgggagcccaaggggaaacactgggagagaaatggaaaaggcagctgaaccaactgagcaaatcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacacgaggaaccaatcccaatggcgacctatggatggaacctagtaaaactgcattccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaatatggaggaatgctagtgcgaaatccactttcaagaaattctactcatgaaatgtattgggtttcatgtgggacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcactatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagtttggaaaggcaaaagggagtcgtgcaatatggtacatgtggttgggagcacgttttctagagtttgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggttcagagaccagcaaaaaatggaaccgtgatggatgtcatatccagacgtgaccaaagaggaagtggccaggtcggaacttatggcttaaacacttttaccaacatggaagcccagctaataagacaaatggagtctgagggaatctttttacccagcgaattggagaccccaaacttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtactttcacaggagagacctgagactagccgccaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5869 - RNA, 9879 nt, synthetic construct
  misc_feature 1..9879: note = derived and/or modified CDS sequence (wt) from DENV-1__GQ199795__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgctactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacctggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcttagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgtatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggttatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagagaaaccttgtgaaaccagaagggaaagtcatagacctcggttgtggaagaggtggctggtcatactattgcgctgggctgaagaaagtcacagaagtgaaggggtatacaaaaggaggacctggacatgaggacccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5870 - RNA, 9873 nt, synthetic construct
  misc_feature 1..9873: note = derived and/or modified CDS sequence (wt) from DENV-1__FJ882547__SS-prME
  source 1..9873: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgtacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggataggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgatgttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttgtgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcaccgatttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaggaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaacgggtggagtgacgctgttcttcctatcaggaaggggcctagggaaaacatctatcggtctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggagaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttctctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcatctccaaacccaactatagaggaaggaagaacgctacgcgtcctaaagatggtggaaccatggctcagaggaaaccaattctgcataaaaattctgaatccctacatgccaagtgtggtggaaactctggaacaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatgtcaccaatagccatgactgacactacacctttggcacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaattttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgaggaaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccactaacatacaagtggctataaaccaagtgagaagactaattgggaatgagaattatctagattacatgacatcaatgaagagattcaagaacgagagtgatcccgaaggggcactctggtga

SEQ ID NO: 5871 - RNA, 9879 nt, synthetic construct
  misc_feature 1..9879: note = derived and/or modified CDS sequence (wt) from DENV-1__GQ199797__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaagaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattgttccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagttcagccgacctatcactagagaaagcagctgaggtctcctgggaagaagaagcagaacactctggtgcctcacacaacatattagtagaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttgacaataatggacctacatccaggatcggggaaaacaagaagatatcttccagccatagtccgtgaggccataaaaaggaagctgcgcacattaattctggctcccacaagagttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtatatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacgtactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgatgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctaacagccattgcaaaccaggcggctatattgatgggacttgacaaaggatggccaatatcgaagatggacataggagttccacttctcgccttagggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaatagttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccaggagagttcttgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagttgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaatcaagtgagaagactaattgggaatgagaattatctagattacatgacatcaatgaagagattcaagaacgagagtgatcctgaaggtgcactctggtga

SEQ ID NO: 5872 - RNA, 9879 nt, synthetic construct
  misc_feature 1..9879: note = derived and/or modified CDS sequence (wt) from DENV-1__GQ199799__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggaaacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcaacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggtttaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgatatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaaccacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggagtaggagtttttcaagaaaacgtgttccacacaatgtggcatgtcaccaggggagctgttctcatgtatcaagggaagaggctggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattttggctcccacaagggttgtcgcttccgaaatggcagaggcgctcaagggaatgccaataaggtaccaaacaacagcagtgaagagtgaacacacaggaaaagagatagttgatctcatgtgtcacgccactttcactatgcgcctcctgtctcccgtgagagttcccaattacaacatgattatcatggatgaagcgcatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgttgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctattcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagctaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcactacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacgctgggagagaaatggaaaagacagctgaaccaactgagtaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagacatcattggccagaggatagagaacataaaacatgaacataagtcaacatggcattatgatgaggacaacccatataaaacatgggcctaccatggatcatatgaggttaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagaggttcaagaatgagagtgatcctgaaggggcactctggtga

SEQ ID NO: 5873 - RNA, 9879 nt, synthetic construct
  misc_feature 1..9879: note = derived and/or modified CDS sequence (wt) from DENV-1__GQ199800__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgagggcgcttggaaacagatacaaagagtggagacttgggccctgagacacccaggattcacggtgatagctctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgcccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacgtcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggataagctgactctaaaggggatgtcatatgtaatgtgcacaggctcattcaagctagagaaagaagtggctgagacccagcatggaaccgttctagtgcagattaaatatgaaggaacagatgcaccatgcaagatcccttttttgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggccgtgttcttccttctcataatgggacaactgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttgtgcctgtccacaacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggagacttcaaggatcctggaacacgggagaagaagtgcaggtgattgctgttgaaccaggaaaaaaccccaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatttcaacccgagtgggcatgggggaagcagctgcgatcttcatgacagctactcccccaggatcagtggaggcctttccacagagtaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggaaagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggtcatgttgcacaactccgaacaaggaggaagagcctatagacatgcaatggaggaattgccagacaccatagaaacgttgatgctcctagctttgatagctgtgttaactggtggagtgacgctgttcttcctatcaggaagaggcctagggaaaacatctatcggcctactctgcgtgatggcttcaagcgtactgctatggatggccagtgtggagccccattggatagcggcctccatcatattggagttcttcctgatggtgctgcttattccagagccagacagacaacgcactccgcaggacaaccagctggcatacgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagctaacctagatatcattggccagaggatagagaacataaaacatgaacataagtcaacatggcattatgatgaggacaatccatacaaaacatgggcctaccatggatcatatgaggtcaagccatcaggatcagcctcatccatggttaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgcttcctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattaccgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttagggaaaagggaagatcaatggtgtggatccctgataggcttaacagcaagggccacctgggccaccaacatacaagtggccataaaccaagtgagaagactaattgggaacgagaattatctagattacatgacatcaatgaagagattcaagaacgagagtgatcctgaaggggcactctggtga

SEQ ID NO: 5874 - RNA, 9879 nt, synthetic construct
  misc_feature 1..9879: note = derived and/or modified CDS sequence (wt) from DENV-1__FJ882548__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctaaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgccttcgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcctccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaatatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggccatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactaacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctactcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatccctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacacgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcagcaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacagaagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5875 - RNA, 9879 nt, synthetic construct
  misc_feature 1..9879: note = derived and/or modified CDS sequence (wt) from DENV-1__GQ199801__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagctttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattatcttcattctgttaatgctggtaacaccatccatggcaatgcgatgtgtgggaataggcagcagggacttcgtggaaggactgtcaggagcaacttgggtagatgtagtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaagactggaaggaaagatagttcaatatgaaaacttgaaatattcagtgatagtcaccgtccacactggagaccagcaccaggtgggaaatgaaagcacagaacacgggacaactgcaactataacacctcaagctccttcaacggaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagagacttggaacagacaagatttgcttgtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaagggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggcagagaactcaaatgtggaagtggcatttttgtcaccaatgaagttcacacttggacagagcaatacaaatttcaagctgactccccaaagagactatcagctgccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctagcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttaatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtaaaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgttagctgtaggactattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgtattccttgcactatgcatggaagacaatggccatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgaaggaatcatggctgttggaatagtcagcattctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggctccaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaaaacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaataccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcagttgagcagaaaaacttttgatacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaaggagcgtctcaggtgatctaatattagaaatagggaaacttccacaacacctgacgcaaagggcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcggctatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccagctgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaatattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcataggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggttacagccaagtggttatggggttttctctctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcgatctttaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaggtggccataaaccaagtgagaagactaattgggaatgagaattatctagattacatgacatcaatgaagagattcaagaacgagagtgatcctgaaggggcactctggtga

SEQ ID NO: 5876 - RNA, 9879 nt, synthetic construct
  misc_feature 1..9879: note = derived and/or modified CDS sequence (wt) from DENV-1__GQ199802__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttgtgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcaaaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgctgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatgggtttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5877 - RNA, 9879 nt, synthetic construct
  misc_feature 1..9879: note = derived and/or modified CDS sequence (wt) from DENV-1__JF937597__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagccatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcatggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccatggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgtagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgccgttgaaccagggaaaaaccccaaaaatgtacaaacggcgccgggcacctttaagacccctgaaggcgaagttggagccatagctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacagaaaaccaacatatgaaagagacgtggacctaggcactggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcaattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5878 - RNA, 9879 nt, synthetic construct
  misc_feature 1..9879: note = derived and/or modified CDS sequence (wt) from DENV-1__GQ868609__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtgctggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccaacaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgactcaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtctctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgagattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagatccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggctaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaattagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5879 - RNA, 9879 nt, synthetic construct
  misc_feature 1..9879: note = derived and/or modified CDS sequence (wt) from DENV-1__GQ199803__SS-prME
  source 1..9879: mol_type = other RNA
tctgtgaccatgctccttatgctgatgcctacagccttggcgttccatttgaccatacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcactcagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagatcaaatacgaaggaacagatgcaccatgcaagatccccttttcgacccaagatgagaaaggagtaacccagaatgggagattaataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcaggttatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaagttccttggaggagctgggggatggacttgcaatgggcattatgattttaaaattgttgactgactttcaatcacatcagctgtgggctaccttgctgtccttgacatttatcaaaacagcattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggcatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggcgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctctgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagacagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtagctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5880 - RNA, 9879 nt, synthetic construct
  misc_feature 1..9879: note = derived and/or modified CDS sequence (wt) from DENV-1__GQ199804__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacagaagtcacaaaccctgccgtcctgcgcaaactgtgcattgaagctaaaatatcaaacaccaccaccgactcaagatgtccaacacaaggagacgccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaagtgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgcgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccatcgtgaacagagaaggaaaaatagtaggtctttatggaaatggagtagtgacaacaagtggaacctacgtcagtgccatagcccaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggagaagcaaggaaaacgtttgtggagctcatgagaagaggagatctacctgtctggctatcctacaaagttgcctcagaaggcttccagtactctgacagaagatggtgctttgacggtgaaaggaacaaccaggtgttggaggagaacatggacgtagagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccggagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacgtgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5881 - RNA, 9879 nt, synthetic construct
  misc_feature 1..9879: note = derived and/or modified CDS sequence (wt) from DENV-1__GQ199805__SS-prME
  source 1..9879: mol_type = other RNA
tctgtgactatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaggggattattttcattttgttaatgctagtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgttctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgactaaactggaaggaaagatagttcaatatgaaaacttgaaatattcagtaatagtcaccgtccacactggagaccagcaccaggtgggaaatgaaagcacagaacatgggacaactgcaactataacaccccaagctcccacgtcggaaatacagttgaccgactacggagctctcacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagacttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatctttggaaccgcatatggagttttgttcagcggtgtttcctggaccatgaaaataggattaggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaggttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaatttacagtggttgtaggagatgtagttgggatcttggctcaagggaaaaaaatgatcaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcccacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaattacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcgatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgaccagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactagccatgtttcttatagcagaaaacaaaatctggggaaggaaaagttggcccctcaatgaaggaattatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaacatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtacttatgtaccaagggaagagactagaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatctttatgacagccactcccccaggatcggtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgcgtcattctagcaggaccgatgccagtaactgtagccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggatcatcccagccctcttcgagccagagagggaaaagagtgcagcaatagacggggaatacagactgcggggtgaagcaaggaagacgtttgtggagctcatgagaagaggagatctgcctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagtgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgctgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacagctaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccttacatgccaagtgtggtggaaactctggagcaaatgcaaagaaaacatggaggaatgctagtgcgaaatccactctcaagaaattctactcatgaaatgtattgggtttcatgtggaacaggaaacattgtgtcagcagtaaacatgacatctagaatgttactaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtagtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagaccactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccagaattactgacatcatggagcccgaacatgccctactggctacgtcaatctttaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgaaggaatctttttacccagcgaattggagacccaaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcttccaacatacaagtggccataaaccaagtgagaagactaattgggaatgagaattatctagattacatgacatcaatgaagagattcaagaacgagggtgatcccgaaggggcactctggtga

SEQ ID NO: 5882 - RNA, 9879 nt, synthetic construct
  misc_feature 1..9879: note = derived and/or modified CDS sequence (wt) from DENV-1__GQ199806__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccatcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacatgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagcagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgtagttggcctagtaacattgtacctaggagttatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccactttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtgctccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcttcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagatgggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcgtatgtggtgataggtttgttattcatgatactgacagtagcagccaatgagatgggactgctggaaaccacaaagaaagatttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctaacagccattgcaaaccaggcggctatattgatgggacttgacaaaggatggccaatatcaaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgaactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaatatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggtttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagccctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagcgatcctgaaggggcactctggtga

SEQ ID NO: 5883 - RNA, 9879 nt, synthetic construct
  misc_feature 1..9879: note = derived and/or modified CDS sequence (wt) from DENV-1__GQ199809__SS-prME
  source 1..9879: mol_type = other RNA
tctgtgaccatgctgctcatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgtagattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggctatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagtcactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggttaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaacgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaggaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaactcgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggatgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacccggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattaccgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctaactgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaatgagggtgatcccgaaggggcactctggtga

SEQ ID NO: 5884 - RNA, 9879 nt, synthetic construct
  misc_feature 1..9879: note = derived and/or modified CDS sequence (wt) from DENV-1__GQ199810__SS-prME
  source 1..9879: mol_type = other RNA
tctgtgaccatgctccttatgctgatgcctacagctttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaagcagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaacctgtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagtagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacttgatctcatatggaggaggttggaggcttcaaggatcctggaacacaggagaagaagtgcaggtgattgctgttgaaccagggaaaaaccccaaaaacgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctctaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaaatcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagagatagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacacaacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggggcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5885 - RNA, 9879 nt, synthetic construct
  misc_feature 1..9879: note = derived and/or modified CDS sequence (wt) from DENV-1__GQ199811__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagtccaatatgaaaacttgaaatattcagtaatagtcaccgtccacacaggagaccagcaccaggtgggaaatgaaagcacagaacatgggacaactgcaactataacacctcaagctccttcgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggggcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaactggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtcttgagaacatcatgtggaagcaaatatcaaatgaactgaactacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttgtcagaacaacgttttccctgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggagtatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaacgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccattatactggagttcttcctgatggtgctgcttattccagagccagacagacaacgcactccgcaggacaaccagctggcatatgtggtgataggtttattattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagctattgcaaaccaggcggctatattgatgggacttgacaaaggatggccaatatcgaagatggatataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaatctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgcgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatctttaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagagactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5886 - RNA, 9879 nt, synthetic construct
  misc_feature 1..9879: note = derived and/or modified CDS sequence (wt) from DENV-1__FJ882549__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaacaccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgttcgtggacagaggctggggcaatggctgtgggctcttcggaaaaggaagcctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggcgaaaaagctttgaaactaagctggttcaagaaaggaagcagcatagggaaaatgtttgaggcaactgccagaggagcacgaaggatggccatattgggagataccgcatgggactttggttctataggaggagtgttcacgtctgttggaaaactagtacaccagatttttggaactgcatatggagttttgttcagcggtgtttcctggaccatgaagataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagctaacgcttccgacaggatggggatgggaacgacgtatctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgattttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttctaatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcattagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaagaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggctgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagtcgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatactagaaatagggaaacttccacaacacttgacgcaaagggcccagaatgctttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaagggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttatttatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagatgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacaccacaccctttggacaacagagggtgcttaaagagaaagttgacacacgcacaccaaaagcaaaacggggcactgcacaaatcatggaggtgacagccaagtggttatggggctttctttccagaaacaaaaaaccaagaatttgtacaagagaggagttcacaagaaaagttaggtcaaacgcagccattggggcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagctggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagcttataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagctttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcctgaaggggcactctggtga

SEQ ID NO: 5887 - RNA, 9879 nt, synthetic construct
  misc_feature 1..9879: note = derived and/or modified CDS sequence (wt) from DENV-1__GQ199814__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcaccctgatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctctcacattggattgttcacctagaacaggactagactttaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggataagctgactctaaaggggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagacaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgtttacgtctgttggaaaattagtacaccagatttttggaactgcatatggagttttgttcagcggtgtttcctggactatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgaccgaagaggtgatgagatccagatggagtagaaaaatgctgatgactggaacactggctgtgttcttccttctcataatgggacaactgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtgcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgttagctgggccactaatagctggaggcatgctaatagcatgttatgttatatccggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacgacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagtaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccataataaggaaggtgatcagtacgtctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatttggttatgttgcacaactccgaacaaggaggaagagcctatagacacgcaatggaggaattgccagacaccatagaaacgttgatgctcctagctttgatagctgtgttaactggtggagtgacgctgttcttcctatcaggaagaggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcagcggtattgatgctagtggctcattacgccataattggacctggactgcaagcaaaagctactagagaagctcaaaaaaggacagcagccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaatattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgagatggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtacgaaatccactttcaagaaattctactcatgaaatgtattgggtttcatgtggaacaggaaacattgtgtcagcagtaaatatgacatccagaatgttgctaaatcgattcacaatggctcacaggaaaccaacgtacgaaagagacgtggacctaggcgccggaacaagacatgtggcagtggaacctgaggtagctaacctagatatcattggccagaggatagagaacataaaacatgaacataagtcaacatggcattatgatgaggacaatccatacaaaacatgggcctaccatggatcatatgaggtcaagccatcaggatcagcctcatccatggttaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaagatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5888 - RNA, 9879 nt, synthetic construct
  misc_feature 1..9879: note = derived and/or modified CDS sequence (wt) from DENV-1__GQ199816__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttaggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacgagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaagcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacatcagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcatggaaaagctggggaaaggctaaaatcataggggcagatgtgcagaatgccaccttcatcatcgacggcccaaacaccccagaatgccctgatgaccaaagagcatggaatatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaatactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcattatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctcctgaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggtatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaataacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcagggaggggcctagggaaaacatctatcggcctactctgtgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttatttatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatacaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtctccatggcaaacatttttagaggaagttatctagcaggagcaggtctggccttctcattaatgaaatctctaggaggaggtaggagaggtacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgagttagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagattgatcctgaaggggcactctggtga

SEQ ID NO: 5889 - RNA, 9879 nt, synthetic construct
  misc_feature 1..9879: note = derived and/or modified CDS sequence (wt) from DENV-1__GQ199817__SS-prME
  source 1..9879: mol_type = other RNA
tctgtgaccatgctccttatgctgatgcccacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggaaacttgggccctgagacacccaggattcacggtgatagccctttttctagcacatgccataggaacatccattacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaacttttgaagacggaagtcacaaaccctgccgtcctgcgtaaactgtgcattgaagccaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcatccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagccgggccgctaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtgcttttggcagaaaaagaaacagagatctggagtgttatgggacacacctagccctccagaagtggaaagagcagttcttgatgatggtatctatagaattatgcagagaggactgttgggcaggtcccaagttggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactatgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcctcttatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcctcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggtcaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagaaggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactactgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggtgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccgtgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaaccagaacatgccctactggctaagtcaatcttcaagctaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5890 - RNA, 9879 nt, synthetic construct
  misc_feature 1..9879: note = derived and/or modified CDS sequence (wt) from DENV-1__FJ882550__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccaaaaggggatcattttcattttgttaatgctggtaacaccatccatggccatgcgatgcgtgggaataggcagcagggacttcgtggaaggactgtcaggagcaacttgggtagacgtagtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggttagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaatgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaaggagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgttacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttctttctaatggtgctgcttattccagagccagacaggcaacgcactccgcaggacaatcagctggcgtatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaaccaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagcacttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5891 - RNA, 9879 nt, synthetic construct
  misc_feature 1..9879: note = derived and/or modified CDS sequence (wt) from DENV-1__FJ882551__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaacgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatgggagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggattagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcgtatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaacattatacctaggagtcatggttcaagcggattcaggatgtgtaattaattggaaaggtagagaactcaaatgtggaagtggcatttttgtcactaatgaagttcacacttggacagagcaatacaaatttcaagctgactctccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaagctaaaatcataggggcagatgtgcagaacaccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaacatctcagcataactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtatggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataataggacaattgacatggaatgatctgatcagactatgcatcatggttggagctaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgttaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgtctcctgtctcccgtgagagttcccaattacaacatgattatcatggatgaagcacatttcaccgatccatccagcatagcggccagagggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcccacaaagttgcctcagaaggctttcagtattctgacagaagatggtgctttgacggggaaaggaacaaccaggtgttggaggagaacatggacgtggagatctggacaaaagaaggagaaagaaagaaactaagaccccgctggctggatgctagaacttactcagacccactggccctgcgcgagtttaaagagtttgcagcaggaagaagaagcgtctcaggcgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggctacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttattgatactatgcacatcacaaatcctcttgatgcggactacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtctcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacaagaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctgaaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaattagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5892 - RNA, 9879 nt, synthetic construct
  misc_feature 1..9879: note = derived and/or modified CDS sequence (wt) from DENV-1__FJ882552__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaaggaattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatactcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagacttcaatgaaatggtgttgttgacaatgaaagaaaaatcatggctggtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattgttccgcagactaacatccagagaagtactccttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcaaaacaacgtcttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtagaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagcgccatagctcaagccaaagcatcacaagaagggcctctaccagagattgaagacgaggtgtttaggaaaagaaacttgacaataatggacctacatccaggatcggggaaaacaagaagatatcttccagccatagtccgtgaggccataaaaaggaagctgcgcacattaattctggctcccacaagagttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtatatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacgtactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttagggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaatcacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaagtgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaagccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaactagagaccccaaatttagccaggagagttcttgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagttgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggtgcactctggtga

SEQ ID NO: 5893 - RNA, 9879 nt, synthetic construct
  misc_feature 1..9879: note = derived and/or modified CDS sequence (wt) from DENV-1__FJ882553__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacattgtaataggagcaggtgaaaaagctttgaaactaagctggttcaggaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattaggatcccttggatgcaaaccactaaccatgtttcttatagcagaaaacaaaatctggggaaggagaagttggcccctcaatgaaggaatcatggctgttggaatagtcagcatcctactaagttcactccttaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagcaaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagaaatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacggtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggactgaaaagaggagaaacaaccaaacatgcagtgtcgagaggaaccgctaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgtataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgaacccgaaggggcactctggtga

SEQ ID NO: 5894 - RNA, 9879 nt, synthetic construct
  misc_feature 1..9879: note = derived and/or modified CDS sequence (wt) from DENV-1__FJ882554__SS-prME
  source 1..9879: mol_type = other RNA
tctgtaaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcatcaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatacagtatagcggccagagggtacatctcaacccgagtgggcatgggtgaagcagctgcaatcttcatgacagccactcccccaggatcagtggaggcctttccacagagcaacgcagttatcaaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccctggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctatcggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5895 - RNA, 9879 nt, synthetic construct
  misc_feature 1..9879: note = derived and/or modified CDS sequence (wt) from DENV-1__GQ868610__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagatgtggtactggaacatggaagctgcgtcaccaccatggcgaaagacaaaccaacattggacattgaactcctgaagacggaagtcacaaaccctgccgtcctgcgcaaactgtgcattgaagctaaaatatcaaacaccaccaccgactcaagatgtccaacacaaggagaagccacactcatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatactcagtaatagtcaccgtccacactggagaccaacaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccaacatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatacggagttttgttcagcggtgtttcctggaccatgaaaataggaataggggttctgctgacatggctaggattaaactcaaggagcacgtccctttcaatgacgtgcattgcagttggcctaataacactatacctaggagtcatggttcaggcggattcaggatgtgtaattaattggaaaggtagagagctcaaatgtggaagtggcatttttgtcaccaatgaagttcacacttggacagagcaatataaatttcaagctgactccccaaagagattatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagtaacggagttctggaaagtgaaatgataattccaaagatctatggaggaccaatatctcagcacaactacagaccaggatatttcacacaaacggcagggccgtggcatctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagcagaaaaatgttgatgactggaacactggctgtgttcctccttctcataatggggcaattgacatggaatgatctgatcagattatgtatcatggttggagccaacgcttccgacaggatggggatgggaacgacgtacctagctctgatagccacttttaaaatgagaccaatgtttgctgtcgggctactattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtcctttacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccattaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggacgaagagagagatgacacgctaaccattctccttaaagcaactctgctagcagtttcaggggtgtacccactatcaataccagcgaccctttttgtgtggtacttttggcagaaaaagaaacagagatctggagtgctatgggatacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtgggacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtcccccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcatcctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttttttctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaatcaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggaggggtctccaggaaaattttggaacaccacgatagcggtttccatggcaaacattttcagaggaagttatctagcaggagcaggtctagccttctcattaatgaaatctttaggaggaggtaggagaggcacgggagcccaaggggaaacactgggagagaaatggaaaaggcagctgaaccaactgagcaagtcagaattcaacacttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgtgtcctaaaaatggtggaaccatggctcagagggaaccaattttgcataaaaattctaaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgttatccccatggtcacacaaatagccatgactgacactacaccctttggacaacagagggtgttcaaagagaaagttgacacgcgcacaccaaaagcaaaacgaggcacagcacaaatcatggaggtgacagccaaatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactgattgggaatgagaattatctagattacatgacatcaatgaagagattcaagaacgagggcgatcccgaaggggcactctggtga

SEQ ID NO: 5896 - RNA, 9879 nt, synthetic construct
  misc_feature 1..9879: note = derived and/or modified CDS sequence (wt) from DENV-1__GQ868611__SS-prME
  source 1..9879: mol_type = other RNA
tctgtgaccatgttccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgacttgtgtgagggtaccacagttgttgtggatgaacattgtggaaatcgaggaccatctcttaggaccacaacagtcacaggaaagataattcatgaatggtgttgcagatcttgcacgttaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagctgacctatcattagagaaagcggctgaggtctcctgggaagaagaagcagaacactctggtgcctcacacaatatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctacagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccagagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaatcgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatctatgaagagattcaagaacgagagtgatcccgaaggggcactctggtga

SEQ ID NO: 5897 - RNA, 9879 nt, synthetic construct
  misc_feature 1..9879: note = derived and/or modified CDS sequence (wt) from DENV-1__FJ882555__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagctatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacattggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcagcatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcttatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagagaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttctgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccaccttcatcatcgacggccaaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttcctcctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccatgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaagtagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagggggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaaggaattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaagggggctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaaccattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccctgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcagatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagctaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagctctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5898 - RNA, 9879 nt, synthetic construct
  misc_feature 1..9879: note = derived and/or modified CDS sequence (wt) from DENV-1__GQ199821__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtgatagtcaccgtccacactggagaccagcaccaggtgggaaatgaaagtacagaacatgggacaactgcaactataacacctcaagctccttcgacggaaatacagctgaccgactatggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagttactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcgactgccagaggagcacgaaggatggccatactaggagacaccgcatgggactttggttctataggaggagtgttcacgtctgttggaaagttagtacaccagatttttggaactgcatatggagttttgttcagcggtgtttcctggaccatgaaaataggaataggagttctgctaacatggctaggactaaactcaaggagcacgtccctttcgatgacgtgcattgtagttggcctagtaacattatacctaggagtcatggttcaggcagattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatagccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgctatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatacatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaatatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5899 - RNA, 9879 nt, synthetic construct
  misc_feature 1..9879: note = derived and/or modified CDS sequence (wt) from DENV-1__FJ882556__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtagaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgctactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacctggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagtttctgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcttagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctatgggctaccttgctgtccttgacatttatcaaaacaacgttttccttgcactacgcatggaaaacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggttatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactctgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagagaaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgacaggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5900 - RNA, 9879 nt, synthetic construct
  misc_feature 1..9879: note = derived and/or modified CDS sequence (wt) from DENV-1__GQ199822__SS-prME
  source 1..9879: mol_type = other RNA
tctgtgaccatgcttctcatgctgatgcccacagccttggcgttccatctgactacacgagggggagagccgcacatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggatcattttcattttgttaatgctggtaacaccatccatggccatgcggtgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccctttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaagagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagtcaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgttttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactgacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagagaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccttagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaacaaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttagacaacctggtcatgttgcacaactccgaacaaggaggaagagcctatagacatgcaatggaagaattgccagacaccatagaaacgctgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacaggcaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaacccactgacgctgacagcggcggtgttgatgctagtggctcattacgccataattggacctggactgcaagcaaaagctactagagaagctcaaaaaaggacagcggccggaataatgaaaaatccaaccgtagatggaattgttgcaatagacttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactacactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggctgtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctatccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactgattgggaatgagaattatctagattacatgacatcaatgaagagattcaagaacgagggtgatcccgaaggggcactctggtga

SEQ ID NO: 5901 - RNA, 9879 nt, synthetic construct
  misc_feature 1..9879: note = derived and/or modified CDS sequence (wt) from DENV-1__FJ882557__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgccttcgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaatatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggccatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcttatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctactcccaggtgaatccactgacgatgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatccctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtctacaacatgatggggaagagagagaaaaaactaggagagtttggaaaggcaaaaggaagtcgtgcaatatggtacatgtggttgggagcacgttttctagagttcgaagctcttggtttcatgaacgaagaccattggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacacgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcagcaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacagaagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5902 - RNA, 9879 nt, synthetic construct
  misc_feature 1..9879: note = derived and/or modified CDS sequence (wt) from DENV-1__FJ882558__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaagaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattgttccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagttcagccgacctatcactagagaaagcagctgaggtctcctgggaagaagaagcagaacactctggtgcctcacacaacatattagtagaggtccaagatgatggaaccatgaagataaaggatgaagagagagatgacacgctaaccattctccttaaagcaactctgctaacagtctcaggggtgtacccattatcaataccagcgaccctttttgtgtggtacttttggcagaaaaagaaacagagatctggagtgttatgggacacacctagccctccaaaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttgacaataatggacctacatccaggatcggggaaaacaagaagatatcttccagccatagtccgtgaggccataaaaaggaagctgcgcacattaattctggctcccacaagagttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtatatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacgtactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgatgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctaacagccattgcaaaccaggcggctatattgatgggacttgacaaaggatggccaatatcgaagatggacataggagttccacttctcgccttagggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaatagttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccaggagagttcttgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagttgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaatcaagtgagaagactaattgggaatgagaattatctagattacatgacatcaatgaagagattcaagaacgagagtgatcctgaaggtgcactctggtga

SEQ ID NO: 5903 - RNA, 9879 nt, synthetic construct
  misc_feature 1..9879: note = derived and/or modified CDS sequence (wt) from DENV-1__GQ199824__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggactcggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgattcaagatgtccaacacaaggagaagccacactggtggaagaacaagacgcgaactttgtgtgtcgacgaacgtttgtggatagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatctttgcaggacacttgaaatgtagactaaagatggacaagctgactctaaaagggatgtcatatgttatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatattaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatctgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttgtgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtatcaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacgacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggagatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccactggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgctataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgcggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaagtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaataagaaaccgagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggcagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaatagggaatgagaattatctagattacatgacatcaatgaagagattcaagaacgagagtgatcctgaaggggcactctggtga

SEQ ID NO: 5904 - RNA, 9879 nt, synthetic construct
  misc_feature 1..9879: note = derived and/or modified CDS sequence (wt) from DENV-1__FJ882559__SS-prME
  source 1..9879: mol_type = other RNA
tctgtgaccatgctccttatgctgatgcccacagcattggcgttccatttgactacacgagggggagagccgcacatgatagtcagcaagcaggaaagaggaaagtcacttttgtttaagacctcagcaggtgtcaacatgtgcaccctcatagcgatggatttgggagagttttgtgaggacacaatgacttacaaatgccctcgaatcactgaggcggaaccagatgacgttgattgttggtgcaatgccacagacacatgggtgacctatggaacatgttctcaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtggaaggactatcaggagcaacttgggtagatgtggtactggaacatggaagttgcgtcaccaccatggcaaaagacaaaccaacattggacattgaactcttgaaaacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacctgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatacgtaatgtgcacaggctcattcaagctagagaaagaagtggctgagacccagcatggaaccgttctagtgcagatcaaatatgaaggaacagatgcaccatgcaagattcctttttcgacccaagatgaaaaaggagtaactcagaatgggagactgataacagctaaccccatagtcactgacaaagaaaaaccagtcaacattgaggcagaaccaccttttggtgagagttacatcgtgataggagcaggtgaaaaagctttgaaactaagctggttcaagaaaggaagcagcataggaaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagtggtgtttcctggaccatgaaaataggaataggggttctgctgacatggctaggattgaactcaaggagcacgtccctttcgatgacgtgcattgcagttggcttagtaacactatatctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgagaatgacatgaaattcacagtggttgtaggagatgttgctggaattttggctcaagggaaaaaaatgattaggccacaacccatggaatacaaatactcatggaaaagctggggaaaggctagaatcataggggcagatgtgcagaataccaccttcatcatcgacggcccaaacaccccagaatgccctgatgaccaaagagcatggaacatttgggaagttgaggactatggatttggaattttcacgacaaacatatggctgaggttgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacaccctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagatagttcatgaatggtgttgcagatcttgtacgctaccacccttacgtttcaaaggagaagatgggtgctggtacggtatggaaatcagaccagtcaaagaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaatgacgtacctagctctgatggccacttttaaaatgagaccaatgtttgctgtaggactattattccgcagactaacatccagagaagttcttcttctaacaattggattaagtctagtggcatctgcggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtgtctctctttcccttatgtctgtccacgacctcccaaaaaacaacatggcttccggtgctattgggatctcttggatgcaaaccactaaccatgtttcttatagcagaaaacaaaatctggggaaggaaaagttggccccttaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaagatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtgcaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcctacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagctaggaaaacgtttgtggagctcatgagaagaggagatctacctgtctggctatcctacaaagttgcctcagaaggctttcagtactctgacagaagatggtgctttgacggggaaaggaacaaccaggtgctggaggagaacatggacgtggagatctggacaaaagaaggagaaagaaagaaactaagaccccgctggctggatgctagaacatactcagacccactagccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaagaactgccagacaccatagaaacattgatgcttctggctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcagaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacgtgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaaggggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaagactgcactccgggaaagacgtattctttacaccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcagtgaacatgacatccagaatgttgctaaatcgattcacaatggcccacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagtacaaatcatggaggtgacagccaagtggttatggggttttctttctagaaataagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaatactttcaccaacatggaagcccagctgataagacagatggagtctgagggaatcttttcacccagcgagttagagaccccaaatttagccgagagagctctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcagtggtgtggatccctgataggcttaacagcaagggctacctgggccactaacatacaagtggccataaaccaagtgagaagactaattgggaatgagaattatctagattacatgacatcaatgaagagattcaagaacgagagtgatcctgaaggggcactctggtga

SEQ ID NO: 5905 - RNA, 9879 nt, synthetic construct
  misc_feature 1..9879: note = derived and/or modified CDS sequence (wt) from DENV-1__GQ199828__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgtacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacctggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtgtctggccaaaatcccacactctatggagcaatggagttcgggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgattggaacactggctgtgttcttccttctcataatgggacaattgacatggaatgatctgatcagattatgcatcatggttggagccaacgcctccgacaggatggggatgggaacgacgtatctagctctaatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaagaatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcactacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggtctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggagaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttctctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaggcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcatctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgaggaaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgataaggctatcgggtcagccgttccagtagattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccactaacatacaagtggctataaaccaagtgagaagactaattgggaatgagaattatctagattacatgacatcaatgaagagattcaagaacgagagtgatcccgaaggggcactctggtga

SEQ ID NO: 5906 - RNA, 9879 nt, synthetic construct
  misc_feature 1..9879: note = derived and/or modified CDS sequence (wt) from DENV-1__GQ199829__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgcttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaagatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccataaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcggccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5907 - RNA, 9879 nt, synthetic construct
  misc_feature 1..9879: note = derived and/or modified CDS sequence (wt) from DENV-1__FJ882562__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtaatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggactgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgtcaccaatgaagttcatacttggacagagcaatacaaatttcaagctgattccccaaagagactatcagcagccattgggaaggcatgggaggaaggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttggctcaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtacctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacattttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacagacagcgccgggcacctttaagacccctgaaggcgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaatttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggacgaagcacattttaccgatccatccagcatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcgaggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatgacttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtggcagccaatgagatgggactgctagaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggagttccacttctcgctttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccctgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5908 - RNA, 9879 nt, synthetic construct
  misc_feature 1..9879: note = derived and/or modified CDS sequence (wt) from DENV-1__FJ882564__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaaccataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatggttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctataaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5909 - RNA, 9879 nt, synthetic construct
  misc_feature 1..9879: note = derived and/or modified CDS sequence (wt) from DENV-1__FJ882565__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacggagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtggctcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgcgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5910 - RNA, 9879 nt, synthetic construct
  misc_feature 1..9879: note = derived and/or modified CDS sequence (wt) from DENV-1__FJ882567__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtagtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaacatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5911 - RNA, 9879 nt, synthetic construct
  misc_feature 1..9879: note = derived and/or modified CDS sequence (wt) from DENV-1__GQ199831__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgagacggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttttagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggttgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagagagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaaccgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgttgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttctcatagcagaaaacaaaatctggggaaggaaaagttggcccctcaatgaaggaatcatggctgttggagtagtcagtatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctacgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggcaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactacaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaaatcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaatatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtagtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgccaatgctatctgttcagccgatccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5912 - RNA, 9879 nt, synthetic construct
  misc_feature 1..9879: note = derived and/or modified CDS sequence (wt) from DENV-1__GQ199832__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttttagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctataaacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcataatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5913 - RNA, 9879 nt, synthetic construct
  misc_feature 1..9879: note = derived and/or modified CDS sequence (wt) from DENV-1__FJ882568__SS-prME
  source 1..9879: mol_type = other RNA
tctgtgaccatgcttcttatgctgatgcccacagccttggcgttccacctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacggttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctgaaagggatgtcatatgtgatgtgcacaggctcattcaagctagagaaagaagtggctgagacccagcatggaaccgttttagtgcagattaaatacgaaggaacagatgcaccatgcaagatcccttttttgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcataatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcagccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5914 - RNA, 9879 nt, synthetic construct
  misc_feature 1..9879: note = derived and/or modified CDS sequence (wt) from DENV-1__FJ882569__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgctttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagttactgataaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagatgtacagaacaccaccttcatcatcgacggcccaaacaccccggaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtattggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtttctcttttccccttatgcctgtccacgacctcccaaaaaacaacgtggcttccggtgctattgggatctcttggatgcaaaccactaaccatgtttcttatagcagaaaacaaaatctggggaaggagaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaatcccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcgggaaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcagtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatacaaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5915 - RNA, 9879 nt, synthetic construct
  misc_feature 1..9879: note = derived and/or modified CDS sequence (wt) from DENV-1__GQ199833__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacagacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagtccaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaaggaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgattgaagaggtgatgagatccagatggagtagaaaaatgttgatgactggaacactggctgtgttcctccttctcataatggggcaattgacatggaatgatctgatcagactatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggcaaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccataataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagagttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagacataccacaatgggaaccttcaaaaggatggaatgactggcaacaagtgcctttttgttcacaccactttcaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagctgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5916 - RNA, 9879 nt, synthetic construct
  misc_feature 1..9879: note = derived and/or modified CDS sequence (wt) from DENV-1__FJ882570__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagagcaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggagatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcaacccaagatggaaaaggagtaacccagaatggaagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattgttccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccattgatagctggaggcatgctaatagcatgttatgttatatctggaagctcagccgacttatcactagagaaagcggctgaggtctcctgggaagaagaagcagaacactctggtgcctcacacaatatattcgtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagctcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagcgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaatagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcataactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcataatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcactacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcattccgggaaggacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattttaaatccctacatgccaagtgtggtggaaactctggagcagatgcaaagaaaacatggaggaatgctagtgcgaaatccactttcaagaaattctactcatgaaatgtattgggtttcatgtggaacaggaaacatcgtgtcagcagtaaacatgacatctagaatgttgctgaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacagatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagacataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5917 - RNA, 9879 nt, synthetic construct
  misc_feature 1..9879: note = derived and/or modified CDS sequence (wt) from DENV-1__GQ199834__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcattgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaactggctgagacccagcatggaaccgttttagtgcagatcaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagatgggatcttggctcaagggaaaaaaatgattaggccacaacccatggaacacaaatactcgtggaaaagctggggaaaagccaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttctcatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgacggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatttcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctctgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacctacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccctaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaagaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaagatggtggaaccatggctcagagggaaccaattttgcataaaaatcctaaatccctacatgccaagtgtggttgaaactctggagcagatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagaaaattcactcagcggagtggaaggagaaggactccacaaactcggatacatactcagagacatatcaaagattccagggggaaatatgtatgcagatgacacagccggatgggatacgaggataacagaggatgatcttcagaatgaggccaaaattactgacatcatggagcccgagcatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtgtcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagctagggctacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5918 - RNA, 9879 nt, synthetic construct
  misc_feature 1..9879: note = derived and/or modified CDS sequence (wt) from DENV-1__GQ199835__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattctgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactcatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacactggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgttggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcgtgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcagattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacactgtggaaatcgaggaccatctcttagaaccacaacagtcacaggaaagataattcatgaatggtgttgcagatcttgtacgctaccacccttacgttttaaaggagaggacgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctaactctgatggccacttttaaaatgagaccaatgtttgctgtcgggctattactccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgtctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagcagtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccattgtgaacagagaagggaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaagacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgatagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggctggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacacgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctgggtggagcctgagagaaactgcatgcctaggcaagtcatatgcacaaatgtggcagctgatgtacttccacaggagagacctgagactagccgctaatgccatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctaggaaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5919 - RNA, 9879 nt, synthetic construct
  misc_feature 1..9879: note = derived and/or modified CDS sequence (wt) from DENV-1__FJ898386__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcagaaccagatgacgttgattgttggtgcaatgccacagacacatgggtgacctatggaacatgttcccaaactggtgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagcccatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctggcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggatataggagttccacttctcgccttggggtgctattcacaggtgaatccactgacgctgacagcggcggtattgatgctagtggctcattacgccataattggacctggactgcaagcaaaagctactagagaagctcaaaaaaggacagccgccggaataatgaaaaatccaaccgttgatggaattgttgcaatagatttggaccctgtggtctatgatgcaaaatttgagaaacaactaggccaaataatgttattaatactatgcacttcacagatcctcttgatgaggactacatgggccttgtgcgaatccatcacactggccactggacctctgaccacgctttgggagggatctccaggaaaattttggaacaccacgatagcggtttccatggcaaatattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaggtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatctgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaacagggtttggatagaggaaaacccatggatggaggacaaaacccatgtatccagttgggaagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcattctggtga

SEQ ID NO: 5920 - RNA, 9879 nt, synthetic construct
  misc_feature 1..9879: note = derived and/or modified CDS sequence (wt) from DENV-1__FJ898387__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcaatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagctgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatacaaaatttgagaaacaactaggccaaataatgttgttgatactatgtacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatctagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaagacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5921 - RNA, 9879 nt, synthetic construct
  misc_feature 1..9879: note = derived and/or modified CDS sequence (wt) from DENV-1__FJ898389__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggacttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtaggacttggtttagaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacgaaccctgccgtcctgcgcaaactgtgcattgaagctaaaatatcaaataccaccaccgactcaagatgtccaacacaaggagaagccacactcatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacactggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgttggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggccccaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacactgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctctttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctatccttgacatttattaaaacaacgctttccttacactatgcatggaagacaatggctatggtactgtcaattgtatctctcttccccttatgcctgtccacgacctcccaaaaaacaacgtggcttccggtgctattgggatcttttggatgcaaaccactagccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagcagtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccattgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccattcagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaagacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgatagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaggcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttggggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctactcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcactaatgaaatctttgggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaacctcgtgaaaccagaagggaaagtcatagacctcggctgtggaagaggtggctggtcatactattgtgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacacgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgaccttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgataggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgccatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctaggaaaaagggaagatcagtggtgtggatccctgataggcttaacagcaagggccacctgggcctccaacatacaagtggccataaaccaagtgagaagactaattgggaatgagaattatctagattacatgacatcaatgaagaggttcaagaacgagggtgatcccgaaggggcactctggtga

SEQ ID NO: 5922 - RNA, 9879 nt, synthetic construct
  misc_feature 1..9879: note = derived and/or modified CDS sequence (wt) from DENV-1__FJ898390__SS-prME
  source 1..9879: mol_type = other RNA
tctgtgaccatgctacttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacactcaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtttctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaagatgagaccaatgtttgctgtcgggctattattccgtagactaacatccagagaagttctccttctcacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtatcaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcctgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgaatcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacagggaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtagtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5923 - RNA, 9879 nt, synthetic construct
  misc_feature 1..9879: note = derived and/or modified CDS sequence (wt) from DENV-1__FJ898391__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaaatgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtgtcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5924 - RNA, 9879 nt, synthetic construct
  misc_feature 1..9879: note = derived and/or modified CDS sequence (wt) from DENV-1__FJ898392__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaaccggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgcggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgcagacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgctggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgtatcatggttggagccaacgcttccgacaggatggggatgggaacgacgtacctagctctgatggccacttttaaaatgagaccaatgtttgctgtcgggctattattccgtagactaacatccagagaagttcttcttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaagagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgttgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataacataaacacaccagaagggattatcccagccctcttcgagccagagagggaaaagagtgcagcaatagacggggaatatagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcataatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttctctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaatcaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatacacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactttggagcagatgcaaagaaaacacggaggaatgctagtgcgaaatccactttcaagaaattctactcatgaaatgtattgggtttcatgtggaacaggaaacattgtgtcagcagtaaacatgacatctagaatgttgctaaatcgattcacaatggcccacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtgcagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaacttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcttccaacatacaagtggccataaaccaagtgagaagactaattgggaatgagaattatctagattacatgacatcaatgaagagattcaagaacgagggtgatcccgaaggggcactctggtga

SEQ ID NO: 5925 - RNA, 9879 nt, synthetic construct
  misc_feature 1..9879: note = derived and/or modified CDS sequence (wt) from DENV-1__FJ898393__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggactgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcatacttggacagagcaatacaaatttcaagctgactccccaaagagactatcagcagccatcgggagggcatgggaggagggtgtgtgtggaattcgatcagccactcgtctcgagaatatcatgtggaagcaaatatcaaatgaactgaaccacatcttacttgaaaatgacatgaaattcacagtggttgtgggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgcatctctcttccccttatgcctgtccacgacctcccaaaaaacaacgtggcttccggtgctattgggatctcttggatgcaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaacatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5926 - RNA, 9879 nt, synthetic construct
  misc_feature 1..9879: note = derived and/or modified CDS sequence (wt) from DENV-1__FJ898394__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgagggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactcatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacactggattgctcacccagaacaggactagactttaatgaaatggtgttgttgacaatgaaagaaaaatcatggctagtccataaacaatggtttctagacctaccactgccttggacctcaggagcttcaacaccacaagagacttggaacagacaagatttgctggtgacatttaagacagctcatgcaaagaagcaggaagtagtcgtactaggatcacaagaaggggcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacataaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcgagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatttagtcaaatcaatggtctctgcagggtcaggggaagtggacagcttttcactaggactactatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgtttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccctggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccctaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcattaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccaatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagcgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaagacatccatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtactgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatgactcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagctgtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaagctcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatctttaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagctgagagggttctcgactggctggaaaaacatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgtctaggcaagtcgtatgcacaaatgtggcagctgatgtacttccataggagagacctgagactagccgctaatgctatctgttcagccgttccagttgattgggtcccaaccagtcgcaccacttggtcgatccatgcccaccaccaatggatgacaacagaagacatgttgtcagtgtggaatagggtttggatagaggaaaacccatggatggaggacaaaactcatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5927 - RNA, 9879 nt, synthetic construct
  misc_feature 1..9879: note = derived and/or modified CDS sequence (wt) from DENV-1__GQ199838__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaaccggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgcttgtggacagaggctggggcaatggctgtgggctcttcggaaaaggaagtctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccaccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgcagacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgtatcatggttggagccaacgcttccgacaggatggggatgggaacgacgtacctagctctgatggccacttttaaaatgagaccaatgtttgctgtcgggctattattccgtagactaacatccagagaagttcttcttcttacaattggattgagtctagtggcatctgtggagttaccaaattccttggaggagttgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaactatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaacatattagtggaggtccaagatgatggaactatgaagataaaggatgaagagagagatgacacgctaaccattctccttaaagcaactttgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaagagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatatagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcataatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaactattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaatcaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatacacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacacggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggggggaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtgcagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatttttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5928 - RNA, 9879 nt, synthetic construct
  misc_feature 1..9879: note = derived and/or modified CDS sequence (wt) from DENV-1__FJ898396__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaactattgactgactttcagtcacatcagctgtgggctaccttgctgtccttgacatttattaaaacaacgctttccttacactatgcatggaagacaatggctatggtattgtcaattgcatctctcttccccttatgcctgtccacgacctcccaaaaaacaacgtggcttccggtgctattgggatctcttggatgcaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacgacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcacactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcggccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5929 - RNA, 9879 nt, synthetic construct
  misc_feature 1..9879: note = derived and/or modified CDS sequence (wt) from DENV-1__GQ199839__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccgaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggagatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtgacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcttgaaattcacagtggttgtaggagatgtagttgggatcttggctcaagggaaaaaaatgattaggccacaacctatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggattatggatttgggattttcacgacaaatatatggttgaaattgcgtgactcctacacccaagtgtgtgaccaccggctaatgtcagctgccatcaaggacagcaaggcagttcatgctgatatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccattgatagctggaggcatgctaatagcatgttatgttatatctggaagctcagccgacttatcactagagaaagcggctgaggtctcctgggaagaagaagcagaacactctggtgcctcacacaatatattcgtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagctcttgatgatggtatctacagaatcatgcagagaggactgttgggtaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagatttcaaacccggcacatctggatctcccatcgtgaacagagaaggaaaaatagtaggtctttatggaaatggagtggtgacaacaagtggaacctacgtcagtgccatagctcaaaccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcgggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcataatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcactacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaattgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcattccgggaaggacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattttaaatccctacatgccaagtgtggtggaaactctggagcagatgcaaagaaaacatggaggaatgctagtgcgaaatccactttcaagaaattctactcatgaaatgtattgggtttcatgtggaacaggaaacatcgtgtcagcagtaaacatgacatctagaatgttgctgaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagacataccacaatgggaaccttcaaaaggatggaatgactggcaacaagtgcctttttgttcacaccacttccaccagctgataatgaaggacgggagggaaatagtggtgccatgtcgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5930 - RNA, 9879 nt, synthetic construct
  misc_feature 1..9879: note = derived and/or modified CDS sequence (wt) from DENV-1__FJ898397__SS-prME
  source 1..9879: mol_type = other RNA
tctgtgaccatgctccttatgctgatgcctacagccttggcgttccatttgactatacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcgtatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcactgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaaaaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttgtggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctacgtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 5931 - RNA, 9879 nt, synthetic construct
  misc_feature 1..9879: note = derived and/or modified CDS sequence (wt) from DENV-1__FJ898398__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcagaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacgataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgggtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagagcatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagttaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcaactggctggaaaaacatggcgtcgaaaggctgaaaagaatggcaatcagcggagatgactgcgtagtgaaaccaattgatgataggtttgcaacagctttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5932 - RNA, 9879 nt, synthetic construct
  misc_feature 1..9879: note = derived and/or modified CDS sequence (wt) from DENV-1__FJ898399__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagccaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctatcggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagtcggcctagtaacgctatacttaggagtcatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactagctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaagacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccttttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5933 - RNA, 9879 nt, synthetic construct
  misc_feature 1..9879: note = derived and/or modified CDS sequence (wt) from DENV-1__FJ898401__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatggacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaaaaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggcacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccatggggaaacactgggagagaaatggaaaagacagctgaaccaactgagcaagtcagaattcaacacttataaaaggagtgggatcatggaagtggacagatctgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaaaaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttgtggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 5934 - RNA, 9879 nt, synthetic construct
  misc_feature 1..9879: note = derived and/or modified CDS sequence (wt) from DENV-1__FJ898402__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaaccataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattgtacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaactacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagctaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgactttccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggacggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgcaaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5935 - RNA, 9879 nt, synthetic construct
  misc_feature 1..9879: note = derived and/or modified CDS sequence (wt) from DENV-1__FJ898403__SS-prME
  source 1..9879: mol_type = other RNA
tctgtgaccatgctccttatgctgatgcctacagccttggcgtttcatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtgggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccattaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatgtaccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 5936 - RNA, 9879 nt, synthetic construct
  misc_feature 1..9879: note = derived and/or modified CDS sequence (wt) from DENV-1__FJ898404__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaactattgactgactttcagtcacatcagctgtgggctaccttgctgtccttgacatttattaaaacaacgctttccttacactatgcatggaagacaatggctatggtattgtcaattgcatctctcttccccttatgcctgtccacgacctcccaaaaaacaacgtggcttccggtgctattgggatctcttggatgcaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacgacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcggccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5937 - RNA, 9879 nt, synthetic construct
  misc_feature 1..9879: note = derived and/or modified CDS sequence (wt) from DENV-1__GQ199840__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactagtggaagaacaagacgcgaactttgtgtgtcgacgaacgttcgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacttcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtaggaaaatgctgatgactggaacactggctgtgttcttccttctcataacgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggatatacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggctagtgccgcccagaggagaggaagaattggaaggaaccacaacaaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacgtactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtagtgataggtttgttattcatgatactgacagtagcagccaatgagatgggactgctggaaaccacaaagaaagacttagggattggccatgtggctgctgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaattcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaatatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagctggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5938 - RNA, 9879 nt, synthetic construct
  misc_feature 1..9879: note = derived and/or modified CDS sequence (wt) from DENV-1__FJ898405__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtaacatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacacaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacattatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaacatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacattcctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaaaatggacataggagttccacttctcgccttggggtgctattcacaggtgaatccactgacgctgacagcggcggtattgatgctagtggctcattacgccataattggacctggactgcaagcaaaagccactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggacaacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctctaacatacaagtggccataaaccaagtgagaagactaattgggaatgagaactatctagattacatgacatcaatgaagagattcaagaacgagggtgatcccgaaggggcactctggtga

SEQ ID NO: 5939 - RNA, 9879 nt, synthetic construct
  misc_feature 1..9879: note = derived and/or modified CDS sequence (wt) from DENV-1__FJ898406__SS-prME
  source 1..9879: mol_type = other RNA
tctgtgaccatgcttcttatgttgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtaacatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaaccgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacattatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaacatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcctgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacattcctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaaaatggacataggagttccacttctcgccttggggtgctattcacaggtgaatccactgacgctgacagcggcggtattgatgctagtggctcattacgccataattggacctggactgcaagcaaaagccactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggacaacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactaaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctctaacatacaagtggccataaaccaagtgagaagactaattgggaatgagaactatctagattacatggcatcaatgaagagattcaagaacgagggtgatcccgaaggggcactctggtga

SEQ ID NO: 5940 - RNA, 9879 nt, synthetic construct
  misc_feature 1..9879: note = derived and/or modified CDS sequence (wt) from DENV-1__GQ199841__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagctacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggcgctggatggagcctgagagaaactgcatgcctaggcaagtcatatgcacaaatgtggcagttgatgtacttccacaggagagacctgagactagccgctaatgctatctgttcagccgtaccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5941 - RNA, 9879 nt, synthetic construct
  misc_feature 1..9879: note = derived and/or modified CDS sequence (wt) from DENV-1__FJ898407__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggatcattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttctccttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaaaccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagagatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5942 - RNA, 9879 nt, synthetic construct
  misc_feature 1..9879: note = derived and/or modified CDS sequence (wt) from DENV-1__FJ898408__SS-prME
  source 1..9879: mol_type = other RNA
tctgtgaccatgcttcttatgctgatgcccacagccttggcgttccatctgaccacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaaccggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgcggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgcagacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgtatcatggttggagccaacgcttccgacaggatggggatgggaacgacgtacctagctctgatggccacttttaaaatgagaccaatgtttgctgtcgggctattattccgtagactaacatccagagaagttcttcttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaagagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgatttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgttgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatatagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcataatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaatcaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtgggagaggtggctggtcatactattgcgctgggctgaagaaagtcacagaagtgaagggatacacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactttggagcagatgcaaagaaaacacggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatgggggtttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggacttcacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtgcagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaacttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgatccaggtgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcttccaacatacaagtggccataaaccaagtgagaagactaattgggaatgagaattatctagattacatgacatcaatgaagagattcaagaacgagggtgatcccgaaggggcactctggtga

SEQ ID NO: 5943 - RNA, 9879 nt, synthetic construct
  misc_feature 1..9879: note = derived and/or modified CDS sequence (wt) from DENV-1__GQ199843__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacccagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtacagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtttcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacatccctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccagtaatactaaaagatggtccagagcgtgtcatcttagcaggaccgatgccagtgactgtggccagtgccgcccagaggagaggaagaattggaaggaaccataataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagagatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgcggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaattgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaaaggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5944 - RNA, 9879 nt, synthetic construct
  misc_feature 1..9879: note = derived and/or modified CDS sequence (wt) from DENV-1__GQ199844__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaattgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgcatctctcttccccttatgcctgtccacgacctcccaaaaaacaacgtggcttccggtgctattgggatctcttggatgcaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcggccattggagcagtgttcgttgatgaaaatcaatggaactcagcaaaagaagcagtggaagatgaacggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5945 - RNA, 9879 nt, synthetic construct
  misc_feature 1..9879: note = derived and/or modified CDS sequence (wt) from DENV-1__GQ199845__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaacttttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggaatgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcatagcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagcagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccacaaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatttggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccacaggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcataaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatacatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaagtggtgagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5946 - RNA, 9879 nt, synthetic construct
  misc_feature 1..9879: note = derived and/or modified CDS sequence (wt) from DENV-1__GQ199846__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccatcatggcgagagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatttatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgcatctctcttccccttatgcctgtccacgacctcccaaaaaacaacgtggcttccggtgctattgggatctcttggatgcaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggcctctaatagctggaggcatgctaatagcatgttatgttatatctggaagctcagccgacttatcactagagaaagcggctgaggtctcctgggaagaagaagcagaacactctggtgcctcgcacaatatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttctcgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagtaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattttagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcaagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaaggggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5947 - RNA, 9879 nt, synthetic construct
  misc_feature 1..9879: note = derived and/or modified CDS sequence (wt) from DENV-1__GQ199847__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctatcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagttcgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgatccaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgatccagatgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 5948 - RNA, 9879 nt, synthetic construct
  misc_feature 1..9879: note = derived and/or modified CDS sequence (wt) from DENV-1__GQ199849__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccgaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggagatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactggctctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtgacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcttgaaattcacagtggttgtaggagatgtagttgggatcttggctcaagggaaaaaaatgattaggccacaacctatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggattatggatttgggattttcacgacaaatatatggttgaaattgcgtgactcctacacccaagtgtgtgaccaccggctaatgtcagctgccatcaaggacagcaaggcagttcatgctgatatggggtactggatagaaagtgaaaggaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccattgatagctggaggcatgctaatagcatgttatgttatatctggaagctcagccgacttatcactagagaaagcggctgaggtctcctgggaagaagaagcagaacactctggtgcctcacacaatatattcgtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagctcttgatgatggtatctacagaatcatgcagagaggactgttgggtaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagatttcaaacccggcacatctggatctcccatcgtgaacagagaaggaaaaatagtaggtctttatggaaatggagtggtgacaacaagtggaacctacgtcagtgccatagctcaaaccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaacgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcataatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcactacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaattgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcattccgggaaggacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattttaaatccctacatgccaagtgtggtggaaactctggagcagatgcaaagaaaacatggaggaatgctagtgcgaaatccactttcaagaaattctactcatgaaatgtattgggtttcatgtggaacaggaaacatcgtgtcagcagtaaacatgacatctagaatgttgctgaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccaggcgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagacataccacaatgggaaccttcaaaaggatggaatgactggcaacaagtgcctttttgttcacaccacttccaccagctgataatgaaggacgggagggaaatagtggtgccatgtcgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5949 - RNA, 9879 nt, synthetic construct
  misc_feature 1..9879: note = derived and/or modified CDS sequence (wt) from DENV-1__FJ898410__SS-prME
  source 1..9879: mol_type = other RNA
tctgtgaccatgctccttatgctgacgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgcccccgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaacccagccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcatagcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagcagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaacaaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattattactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctagccttctcattaatgaaatctctaggaggaggtaggagaggcacgggagcccaaggggaaacactgggagagaaatggaaaagacagctgaaccaactgagtaagccagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaagtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcataaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5950 - RNA, 9879 nt, synthetic construct
  misc_feature 1..9879: note = derived and/or modified CDS sequence (wt) from DENV-1__FJ898411__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatctatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgacggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgatccaattgagcagaaaaacttttgatacagagtaccaaaaaacaaaaaacaacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 5951 - RNA, 9879 nt, synthetic construct
  misc_feature 1..9879: note = derived and/or modified CDS sequence (wt) from DENV-1__FJ898412__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgtcgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactcatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtgatagtcaccgtccatactggagaccagcaccaggtgggaaatgaaagcacagaacatgggacaactgcaactataacacctcaagctcctacgtcggaaatacagctgaccgactacggagctcttacactggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgtaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacactgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagtcctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccattgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaagacagtttggtttgttccaagcatcaaatcaggaaacgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgatagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaaccagctggcatatgtggtgataggtttgttattcatgatactgacagtagcagccaatgagatgggactactggaaaccacaaagaaagacttagggattggccatgtggctgttgaaaatcaccaccatgtcacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtgttgatgctagtggctcattacgccataattggacctggactgcaagcaaaagccactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctttaggaggaggtaggagaggcacgggagcccaaggggaaacactgggagagaaatggaaaaggcagctgaaccaactgagcaagtcagaattcaacatttacaaaaggagcgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacacgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctaaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgtcgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgccatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctaggaaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5952 - RNA, 9879 nt, synthetic construct
  misc_feature 1..9879: note = derived and/or modified CDS sequence (wt) from DENV-1__GQ199852__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgttcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtaggaaaatgttgacgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgcttcccttacactgtgcatggaagacaatggctatggtattgtcaattgcatctctcttccccttatgcctgtccacgacctcccaaaaaacaacgtggcttccggtgctattgggatctcttggatgcaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacgacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcggccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5953 - RNA, 9879 nt, synthetic construct
  misc_feature 1..9879: note = derived and/or modified CDS sequence (wt) from DENV-1__FJ898415__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggagacaagaaccgaaacgtggatgtcctctgaaggcgcttggaaacagatacaaagagtggagacttgggccttgagacacccaggattcacggtgatagccctttttctagcacatgccataggaacatccatcacccagaaggggattattttcattttgttaatgctggtaacaccatccatggctatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagttgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatcccttttttgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagcaacatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagacaattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacattatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaacatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacattcctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaaaatggacataggagttccacttctcgccttggggtgctattcacaggtgaatccactgacgctgacagcggcggtattgatgctagtggctcattacgccataattggacctggactgcaggcaaaagccactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggacacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctctaacatacaagtggccataaaccaagtgagaagactaattgggaatgagaactatctagattacatgacatcaatgaagagattcaagaacgagggtgatcccgaaggggcactctggtga

SEQ ID NO: 5954 - RNA, 9879 nt, synthetic construct
  misc_feature 1..9879: note = derived and/or modified CDS sequence (wt) from DENV-1__FJ898416__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactggtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgcatctctcttccccttatgcctgtccacgacctcccaaaaaacaacgtggcttccggtgctattgggatctcttggatgtaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaaacatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgcttaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacgacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcggccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggtaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggtactctggtga

SEQ ID NO: 5955 - RNA, 9879 nt, synthetic construct
  misc_feature 1..9879: note = derived and/or modified CDS sequence (wt) from DENV-1__FJ898417__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatctatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctctcacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgacggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgatccaattgagcagaaaaacttttgatacagagtaccaaaaaacaaaaaacaacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcttatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgatccagttgattgggtcccaaccagccgcaccacctggtcgatccatgcccatcaccaatggatgacaacagaagacatgctgtcagtgtggaatagggtttggatagaggaaaacccatggatggaggacaaaacccacatatctagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 5956 - RNA, 9879 nt, synthetic construct
  misc_feature 1..9879: note = derived and/or modified CDS sequence (wt) from DENV-1__GQ868612__SS-prME
  source 1..9879: mol_type = other RNA
tctgtgaccatgctccttatgctgatgcctacagccttggcattccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagccatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctctcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagaggggctgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5957 - RNA, 9879 nt, synthetic construct
  misc_feature 1..9879: note = derived and/or modified CDS sequence (wt) from DENV-1__FJ898419__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacaccccaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagttcgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgatccaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggatggacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 5958 - RNA, 9879 nt, synthetic construct
  misc_feature 1..9879: note = derived and/or modified CDS sequence (wt) from DENV-1__FJ898420__SS-prME
  source 1..9879: mol_type = other RNA
tctgtgaccatgctccttatgctgatgcctacagccttggcattccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagccatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaggttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagaggggctgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaagagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5959 - RNA, 9879 nt, synthetic construct
  misc_feature 1..9879: note = derived and/or modified CDS sequence (wt) from DENV-1__FJ898421__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctaagcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggataaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaagtttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtggtcccgaaggggcactctggtga

SEQ ID NO: 5960 - RNA, 9879 nt, synthetic construct
  misc_feature 1..9879: note = derived and/or modified CDS sequence (wt) from DENV-1__FJ898423__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaaaacctcagcaggtgtcaacatgtgcaccctcatagcgatggatttgggagagttatgtgaggacacaatgacttacaaatgtcctcgaattactgaggtggaaccagatgacgttgattgttggtgcaacaccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggccctgagacacccaggattcacggtgatagccctttttctagcacatgccataggaacatccatcacccagaaagggattattttcattctgttaatgctggtaacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagataattcaatatgaaaatttgaaatattcagtaatagtcaccgtccacactggagaccagcaccaggtgggaaatgaaagcacagaacatgggacaattgcaactataacacctcaagctcctacgtcggaaatacagctgaccgactacggagctcttacattggactgctcacctagaacaggactggactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgaccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttctagtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctaataacactatacctaggagtcatggttcaggcggattcaggatgtgtaattaattggaagggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatggttaggccacaacccatggaacacaaatactcgtggaaaagctggggaaaagccaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattacgtgactcctacacccaagtatgtgaccaccggctaatgtcagctgccatcaaggacagcaaggcagttcacgctgatatggggtactggatagaaagtgaaaagaatgagacctggaagttggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatggatgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacattggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacgtggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcactttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgaccagtacatctacatgggacagcctttaaacaacgatgaagatcacgcccactggacagaagcaaaaatgctccttgataatataaacacaccagaagggatcatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaaaaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccccgtggtttatgatgcaaaatttgagaaacaattaggccaaataatgttgttgatactatgcacatcacagatccttttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaagaaggaagaacgttacgcgtcctaaagatggtggaaccatggctcagaggaaaccaattctgcataaagattctgaatccctacatgccaagtgtggtggaaaccctggaacatatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacaccacaccctttggacaacagagggtgtttaaagagaaagttgacacacgcacaccaaaagcaaaacgaggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaatatggcgtcgaaaggctaaaaagaatggcaatcagcggagatgactgcgtggtgaaaccaattgatgacaggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5961 - RNA, 9879 nt, synthetic construct
  misc_feature 1..9879: note = derived and/or modified CDS sequence (wt) from DENV-1__FJ898424__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcaacaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggttgtggactcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcatggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtttcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttgtcctacaaagttgcctcagaaggcttccagtactccgatagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagagatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaatatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5962 - RNA, 9879 nt, synthetic construct
  misc_feature 1..9879: note = derived and/or modified CDS sequence (wt) from DENV-1__FJ898425__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggactatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcactaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttagacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgcacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttcttgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5963 - RNA, 9879 nt, synthetic construct
  misc_feature 1..9879: note = derived and/or modified CDS sequence (wt) from DENV-1__FJ898426__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcgcaaaccctgccgtcctgcgtaaactgtgcattgaagccaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctatcggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactagctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaataccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaagacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccttttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaatatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5964 - RNA, 9879 nt, synthetic construct
  misc_feature 1..9879: note = derived and/or modified CDS sequence (wt) from DENV-1__GQ199856__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttgtagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcgtatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataataggacaattgacatggaatgacttgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacattcatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggagaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtatccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaattttgtgaaaccagaagggaaagtcatagacctcggttgtggaagaggtggctggtcatactattgcgccgggctgaagaaagtcacagaagtgaagggatatacgaaaggaggacctggacatgaagagccaattccaatggcgacctatggatggaacctagtaaaactgcactccgggaaagacgtgttctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcgaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagttaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagattatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5965 - RNA, 9879 nt, synthetic construct
  misc_feature 1..9879: note = derived and/or modified CDS sequence (wt) from DENV-1__FJ898427__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccctgctgtccttgacatttattaaaacaacgctttccttacactgtgcatggaagacaatggctatggtattgtcaattgcatctctcttccccttatgcctgtccacgacctcccaaaaaacaacgtggcttccggtgctattgggatctcttggatgcaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacgacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcggccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5966 - RNA, 9879 nt, synthetic construct
  misc_feature 1..9879: note = derived and/or modified CDS sequence (wt) from DENV-1__JF937599__SS-prME
  source 1..9879: mol_type = other RNA
tctgtgaccatgctccttatgctgatgcctacagccttggcgttccatttgactgcacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggaaacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaagtccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggtttaaactcaaggagcacgtccctttcgatgacgtgcattgcagttggcctagtaacattatacctaggagtcatggttcaggcggattcaggatgtgtgattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagaggctggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacgttaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgatagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagccagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggttaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5967 - RNA, 9879 nt, synthetic construct
  misc_feature 1..9879: note = derived and/or modified CDS sequence (wt) from DENV-1__FJ898431__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaacagaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctccttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgctcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgaccttatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcctccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaagcttccacaacacttgacgcaaagggcccagaacgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgttgacagcggcggtgttgatgctagtggctcattacgccataattggacctggactgcaagcaaaagctactagagaagctcaaaaaaggacagcggccggaataatgaagaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttacctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatctatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagtttacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaagagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagttagaagactaattgggaatgagaattatttagattacatgacatcaatgaagagattcaagaacgagagtgatcctgaaggggcactctggtga

SEQ ID NO: 5968 - RNA, 9879 nt, synthetic construct
  misc_feature 1..9879: note = derived and/or modified CDS sequence (wt) from DENV-1__GU131678__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtagagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagcctactaacgtgtgctaagttcaagtgtatgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtattaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaacattgaggcagaaccgccttttggtgagagttacatcgtgataggagcaggtgaaaaagctttgaaactaagctggttcaagaaaggaagtagcatagggaaaatgtttaaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagctttttactaggactgctatgcatatcaataatgatcgaagaggtgatgagatccagatggagtaggaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccccaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgccggggaaaggaacaaccaggtgttggaggagaacatggacgtggagatctggacaaaagaaggagaaagaaagaaactattaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatgggcagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgccaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgtgaatccatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggcctgaaaagaggagaaacaaccaaacatgcagtgtcgagaggacccgctaaactgaggtggtttgtggagaggacccttgtgaacccagaagggaaagtcatagcccttggttgtggaagaggtgcctggtcatactattgcgctgggctgaagaaaggcacagaagtgaagggatatacaaaaggaggacctggacatgaggaaccaatcccaatggcgacctatggatgggacctagtaaaactgcactccgggaaagacgtattcttcataccacctgagaaatgtgatacccttttgtgtgatattggtgagtcctctccaaacccaactatagaggaaggaagaaccctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggacccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtcccacgtgtgtttacaacatgatggggaagagagaaaaaaaactaggagagttcggaaaggcaaaaggaagccgtccaatatggtacatgtggttgggagcacgctttctagagtttgaagctcttggtttcatgaacgaagatcactggttcagcagagagaattcactcagcggagtggaaggggaagcacttcacaaacttggatatatactcagagacatatcaaagattccagggggaaacatgtatgcagatgacacagccggatgggatacaaggataacagaggatgacctccagaatgagggcaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggaccctgagagaaactgcatgcctaggcaagtcatatgcacaaatgtggcagctgatgtacttccccaggagagccctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacaccaagggccacctggcccaccaacatacaagtggccataaaccaagtgagaagactaattgggaatgagaattattcagattacatgacatcaatgaagagattcaagaacgagagtgaacccgaaggggcactctggtga

SEQ ID NO: 5969 - RNA, 9879 nt, synthetic construct
  misc_feature 1..9879: note = derived and/or modified CDS sequence (wt) from DENV-1__GU131679__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttaggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagcaaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaagcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacatcagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcatggaaaagctggggaaaggctaaaatcataggggcagatgtgcagaatgccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggtattatgattttaaaattattgactgactttcaatcacatcagttgtgggctaccttgctgtccttgacatttatcaaaacaacgttttccttgcattatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacatgctaaccattctcctgaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggtatgggtgaagcagctgctatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaataacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcagggaggggcctagggaaaacatctatcggcctactctgtgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagaattggatcccgtggtttatgatacaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtctccatggcaaacatttttagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactttggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggtaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagattgatcctgaaggggcactctggtga

SEQ ID NO: 5970 - RNA, 9879 nt, synthetic construct
  misc_feature 1..9879: note = derived and/or modified CDS sequence (wt) from DENV-1__GU131680__SS-prME
  source 1..9879: mol_type = other RNA
tctgtgaccatgctccttatgctgatgcctacagccctggcgttccatttgactacacgagggggagagccgcacatggtagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtggagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgtgaatccatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 5971 - RNA, 9879 nt, synthetic construct
  misc_feature 1..9879: note = derived and/or modified CDS sequence (wt) from DENV-1__GU131681__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggatacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccacaaacaatggtttctagacctaccactgccctggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcaacacaactacagaccaggatatttcacacaaacggcagggccgtggcacctaggtaagttggaactggattttgatttgtgtgagggtaccacagttgttgtagatgaacattgtggaaatcgaggaccatctcttagaaccacaacagtcacaggaaagataattcatgaatggtgttgcagatcttgcacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaagtgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttctcacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagccgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatagtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacatccctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccaatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacactgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgcacaagagaggagttcacaagaaaagtcaggtcaaacgcagccattggagcggtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggattcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatgggagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggcaacctgggcctctaacatacaagtggccataaaccaagtgagaagactaattgggaatgagaattatctagattacatgacatcaatgaagagattcaagaacgagggtgatcccgaaggggcactctggtga

SEQ ID NO: 5972 - RNA, 9879 nt, synthetic construct
  misc_feature 1..9879: note = derived and/or modified CDS sequence (wt) from DENV-1__GU131682__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttaacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacatctggaacgacaacaatttttgcaggacacttgaagtgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagttatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagggcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctaaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttctgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5973 - RNA, 9879 nt, synthetic construct
  misc_feature 1..9879: note = derived and/or modified CDS sequence (wt) from DENV-1__GU131683__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagaccccagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggcttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagttacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagcccacaaacaatggtttttagacctaccactgccttggacctcgggagcttcaacatcacaagagacttggaacagacaagatctgctggtgacgtttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccccttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgctggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatataaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctttttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcgaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctacgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagctgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5974 - RNA, 9879 nt, synthetic construct
  misc_feature 1..9879: note = derived and/or modified CDS sequence (wt) from DENV-1__GU131684__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagctatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaggatgggtgctggtacggtatggaaatcagaccagtcaaggaaaaggaagagaatctagtcaaatcaaaggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagccgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagggggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgcccactggacagaagcaaaaatgctccttgataatataaacacaccagaaggaattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaagggggctagggaaaacatccatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaaccattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcctgatgcggactacatgggccctgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacgacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5975 - RNA, 9879 nt, synthetic construct
  misc_feature 1..9879: note = derived and/or modified CDS sequence (wt) from DENV-1__GU131685__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctctttggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggaaaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatggtatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgctgggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcggaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5976 - RNA, 9879 nt, synthetic construct
  misc_feature 1..9879: note = derived and/or modified CDS sequence (wt) from DENV-1__GQ868614__SS-prME
  source 1..9879: mol_type = other RNA
tctgtgaccatgctgctcatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgtagattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaaatgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggcccattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggagctgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagtcactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggttaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaacgatgtgccgctagctgggccactgatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaggaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaactcgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggatgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacccggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaaccgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattaccgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaatgagggtgatcccgaaggggcactctggtga

SEQ ID NO: 5977 - RNA, 9879 nt, synthetic construct
  misc_feature 1..9879: note = derived and/or modified CDS sequence (wt) from DENV-1__GU131688__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacagaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaatgacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgtcggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggctacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgatccaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggcgaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagggaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatgggtggaacctagtaaaactgcactccgggaaagacgtattctttataccacccgagaaatgtgacacccttttgtgtgatattggtgagtcctctccaaacccaactatagaggaaggaagaacgctacgcgtccttaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcagcagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 5978 - RNA, 9879 nt, synthetic construct
  misc_feature 1..9879: note = derived and/or modified CDS sequence (wt) from DENV-1__GU131689__SS-prME
  source 1..9879: mol_type = other RNA
tctgtgaccatgttccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatctcaaacaccaccacagactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgccaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtacagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacatctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtgtctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacactaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccatgaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagatatctccgaaatgggagcaaatttccgggccgacagggtgatagacccaagacggtgtctgaaaccggtaatactaaaagatggtccagagcgtgtcattttagcaggaccgatgccagtgactgtagccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgaatttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgttagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgaggggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggaagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgttatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggctataaaccaagtgagaagactacttgggaatgagaattatctagattacatgacatcaatgaagagattcaagaatgagagtgatcctgaaggggcactctggtga

SEQ ID NO: 5979 - RNA, 9879 nt, synthetic construct
  misc_feature 1..9879: note = derived and/or modified CDS sequence (wt) from DENV-1__GU131690__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaagcatgggaggagggtgtgtgtggaattcgatcagtaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcatagtgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcagttgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaagaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagcctcattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgttagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgttcaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgactgcgtggtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5980 - RNA, 9879 nt, synthetic construct
  misc_feature 1..9879: note = derived and/or modified CDS sequence (wt) from DENV-1__GU131695__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctctttggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccaccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacctggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatggtatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgcggaaatcgaggaccatctcttaggaccacaacagtcacagggaagataattcatgaatggtgttgcagaacttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttctcatagcggaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcaccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggaaggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcactaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagccctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5981 - RNA, 9879 nt, synthetic construct
  misc_feature 1..9879: note = derived and/or modified CDS sequence (wt) from DENV-1__GU131697__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagtaccaggtgggaaatgaaagcacagaacatgggacaactgcaactataacacctcaagctcctacgacggaaatacagctaaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacaaacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatgggaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctaggattaaactcaaggagcacgtccctctcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgccttcgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaatatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggccatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaacaacgactgggactacgtcgtcacaacagacatctccgaaatgggagcgaatttccgggctgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaacaaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctactcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatccctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgagaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttttgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcggatgacacagccggatgggatacaaggataacagaggatgaccttcagaatgaggccaaaattactgacatcatggaacccgaacacgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaagggatggaatgattggcagcaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacagaagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5982 - RNA, 9879 nt, synthetic construct
  misc_feature 1..9879: note = derived and/or modified CDS sequence (wt) from DENV-1__GU131700__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaagaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcattatcgacggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattgttccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagttcagccgacctatcactagagaaagcagctgaggtctcctgggaagaagaagcagaacactctggtgcctcacacaacatattagtagaggtccaagatgatggaaccatgaagataaaggatgaagagagagatgacacgctaaccattctccttaaagcaactctgctaacagtctcaggggtgtacccattatcaataccagcgaccctttttgtgtggtacttttggcagaaaaagaaacagagatctggagtgttatgggacacacctagccctccaaaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttgacaataatggacctacatccaggatcggggaaaacaagaagatatcttccagccatagtccgtgaggccataaaaaggaagctgcgcacattaattctggctcctacaagagttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtatatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaatcaggtgttggaggagaacatggacgtggagatctggacaaaagaaggagaaagaaagaaactaagaccccgctggctggatgctagaacgtactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgatgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctaacagccattgcaaaccaggcggctatattgatgggacttgacaaaggatggccaatatcgaagatggacataggagttccacttctcgccttagggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaatagttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagcccggagagttcttgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagttgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaatcaagtgagaagactaattgggaatgagaattatctagattacatgacatcaatgaagagattcaagaacgagagtgatcctgaaggtgcactctggtga

SEQ ID NO: 5983 - RNA, 9879 nt, synthetic construct
  misc_feature 1..9879: note = derived and/or modified CDS sequence (wt) from DENV-1__GU131701__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgacagccctttttctagcacatgtcataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaagtgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccacagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaaccacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacctttaaaatgagaccgatgtttgctgtagggctattatttcgcagactaacatccagagaagttcttcttctaacaattggattgagtctagtggcatctgtggagctaccaaattccttggaggagctgggggatggacttgcaatgggcattatgattttaaaattattgactgactttcaaccacatcaactgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagctggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtatcaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagcgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggtgaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccggagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccatcgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgcattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcaataaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacagacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccaggaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactttggtga

SEQ ID NO: 5984 - RNA, 9879 nt, synthetic construct
  misc_feature 1..9879: note = derived and/or modified CDS sequence (wt) from DENV-1__GU131703__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcctgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttctcatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctcctcaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacaacgccgggcacttttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagtttttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttggggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagcggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5985 - RNA, 9879 nt, synthetic construct
  misc_feature 1..9879: note = derived and/or modified CDS sequence (wt) from DENV-1__GU131706__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacattgtaataggagcaggtgaaaaagctttgaaactaagctggttcaggaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaatgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattaggatcccttggatgcaaaccactaaccatgtttcttatagcagaaaacaaaatctggggaaggagaagttggcccctcaatgaaggaatcatggctgttggaatagtcagcatcctactaagttcactccttaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccatcatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctaccagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaagtggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgtataaaaattctgaatccctacatgccaagtgtggtggaaactctggagcaaatgcagagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagatctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5986 - RNA, 9879 nt, synthetic construct
  misc_feature 1..9879: note = derived and/or modified CDS sequence (wt) from DENV-1__GU131708__SS-prME
  source 1..9879: mol_type = other RNA
tctgtgaccatgctccttatgctgatgcctacagccttggcgttccatttgactacacgagggggagagccgcacatggtagtcagcaagcaggaaagaggaaaatcactcttgttcaagacctcagcaggtgtcaacatgtgcacccttatagcgatggatttgggagagttatgtgaggacacaatgacttacaaatgccctcgaatcactgaagctgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacctggaacagacaagatttgctggtgacatttaagacagctcatgcaaagaagcaggaagtagtcgtgctaggatcacaagaaggagcaatgcacactgcgttgaccggagcaacagaaatccaaacgtcaggaacgacaacaatttttgcaggacacttgaaatgcagactaaagatggacaaactgactctaaaagggatgtcatatgtgatgtgcacaagctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggattaggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacgtcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcatgggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgacagactttcaatcacatcagctgtgggccaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccatcctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaagacgaggtgtttaggaaaagaaacttgacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgcctataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagtattaaatcaggaaatgacatagccaactgcctaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacgaaagagggagaaagaaagaaactacgaccccgctggctggatgccagaacatactcagacccactagccctgcgcgagttcaaagagtttgcagcagggagaagaagcgtctcaggtgatctaatattagaaatagggaaacttccacaacacttgacgcaaagggcccagaatgccctggacaacctggttatgttgcacaactccgaacaaggaggaagagcctacagacatgcaatggaagaactgccagacaccatagaaacgttgatgctcctagctttgatagctgtgttaactggtggagtgacactgttcttcttatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgcggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacccctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagttgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgttgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5987 - RNA, 9879 nt, synthetic construct
  misc_feature 1..9879: note = derived and/or modified CDS sequence (wt) from DENV-1__GU131710__SS-prME
  source 1..9879: mol_type = other RNA
tctgtgaccatgctccttatgctgatgcctacagccttggcgttccatttgactacacgagggggagagccgcacatgatagccagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagatctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctaataacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccattgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagctggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagagaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgacccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgctgcaatgctggacgtagacttacatccagcttcagcctggaccctctatgcagtggccacaacaattatcactcccatgatgaggcacacaatcgaaaacacaacggcaaacatttccctgacagccattgcaaatcaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcggcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagactacatgacatcaatgaagagattcaagaacgagagtgatcccgaaggggcactctggtga

SEQ ID NO: 5988 - RNA, 9879 nt, synthetic construct
  misc_feature 1..9879: note = derived and/or modified CDS sequence (wt) from DENV-1__GU131717__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacagaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaatgacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaaactttgaaactaagctggttcaagaaaggaagcagcatagggaaaatgtttgaggcaactgccagaggagcacgaaggatggccatactgggagacaccgcatgggactttggttctataggaggagtgttcacgtctgtcggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggctacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctgctaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgcatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgatccaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggcgaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgcagggctgaagaaagtcacagaagtgaagggatatacgaaaggaggacctggacatgaggagccaattccaatggcgacctatgggtggaacctagtaaaactgcactccgggaaagacgtattctttataccacccgagaaatgtgacacccttttgtgtgatattggtgagtcctctccaaacccaactatagaggaaggaagaacgctacgcgtccttaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcagcagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 5989 - RNA, 9879 nt, synthetic construct
  misc_feature 1..9879: note = derived and/or modified CDS sequence (wt) from DENV-1__GU131718__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcatagaacatgggacaactgcaactataacacctcaagctcccacgtcagaaatacagctgaccgactacggagctcttacattggattgctcacccagaacaggattagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttttcgacccaagatgaaaaaggagtaacccagaatgggagactgataacagctaatcctatagtcattgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgggctacattgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctaaaaaatgatgtgccgctagctgggccactaatagctggaggcatgctaatagcatgttatgtcatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttctcgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttctgaaatggcagaggcgctcaagggaatgccaataaggtaccaaacaacagcagtgaagagtgaacacacaggaaaagagatagttgacctcatgtgccacgccactttcaccatgcgtctcctgtcccccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgatattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggatcatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgatggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctagcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttctctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacaccctcttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatacaaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaaggaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttatcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5990 - RNA, 9879 nt, synthetic construct
  misc_feature 1..9879: note = derived and/or modified CDS sequence (wt) from DENV-1__GU131720__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggatcattttcattttgttaatgctggtaacaccatccatggccatgcgatgcgtgggaataggcagcagggacttcgtggaaggactgtcaggagcaacttgggtagacgtagtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggttagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcggtcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcgcgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatcttttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctggctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgttcaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagctactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgttacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatattggagttcttcctaatggtgctgcttattccagagccagacaggcaacgcactccgcaggacaatcagctggcgtatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgctataattggacctggactgcaagcaaaagctactagagaagctcaaaaaaggacagcggccggaataatgaaaaatccaaccgtagatggaattgttgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccaaaattactgacatcatgaagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccaattgattgggttccaaccagtcgcaccacctggtcgatccatgcccaccaccaatggatgacaacagaagacatgttgtcagtatggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5991 - RNA, 9879 nt, synthetic construct
  misc_feature 1..9879: note = derived and/or modified CDS sequence (wt) from DENV-1__HM181960__SS-prME
  source 1..9879: mol_type = other RNA
tctgtgaccatgctccttatgctgatgcctacagccttggcgttccacttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgttggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgtactagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggctatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgcctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagacgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgctctagactttaaacctggcacatctggatctcccatcgtgaacagagaaggaaaaatagtaggtctctatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtaaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgtcccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataacataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccctggacaacctggttatgttgcacaattccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtgctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcttggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggagagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggctgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacctagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagatatgctgtcagtgtggaacagggtttggatagaggaaaacccatggatggaggacaaaacccacatatccagttggggagatgttccatacttaggaaaaagggaagaccaatggtgtggatccctgataggcttaacagcaagggccacctgggccaccaatatacaagtggccataaaccaagtgagaagactaattgggaatgagaattatctagattacatgacatcaatgaagagattcaagaacgagagtgatcccgaaggggcactctggtga

SEQ ID NO: 5992 - RNA, 9879 nt, synthetic construct
  misc_feature 1..9879: note = derived and/or modified CDS sequence (wt) from DENV-1__HM181963__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagctatggatttgggagagttttgtgaggacacaatgacttacaagtgccctcgaatcactgaggcggaaccagatgacgttgattgttggtgcaatgccacagacacatgggtgacctatggaacatgttcccaaattggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacattggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacaacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagagaaaccagtcaacattgaggcagaaccgccttttggtgagagttacatcgtgataggagtaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttctgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaacggagttctggaaagtgaaatgataattccgaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttcctcctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccatgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggttcaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaagtagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccggccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagggggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtttgaaaccggtaatactaaaagatggtccagagcgtgtcattttagcaggaccgatgccagtgactgtggccagtgccgcccagaggagaggaagaattggaaggaaccataataaggaaggtgaccagtacatctacatgggacagcctttaaacaacgatgaagatcatgctcactggacagaagcaaaaatgctccttgataatataaacacaccagaaggaattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcttatagacatgcaatggaagaactgccagacaccatagaaacgttgatgctcctagctttgatagctgtgttaactggtggagtgacgctgttcttcctatcaggaagggggctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaaccattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccctgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagctctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5993 - RNA, 9879 nt, synthetic construct
  misc_feature 1..9879: note = derived and/or modified CDS sequence (wt) from DENV-1__HM181964__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgctggtgtaatgccacagacacatgggtgacctatggaacatgttcccaaactggtgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgacctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactgcgcatggaagacaatggctatggtactgtcaattgtatctctcttccctttatgcctgtccacgacctcccaaaaaacaacatggcttccggtgttattgggatcccttggatgcaaaccactaaccatgtttcttatagcagagaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggccttcccactgagcaacgcagttatccaagatgaggaaagagacattcctgagagatcatggaactcaggctatgagtggatcactgatttcccaggtaaaacagtttggtttgttccaagcattaaatcaggaaatgacattgccaactgtttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacactatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacaaacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatccttttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttaggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgatacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5994 - RNA, 9879 nt, synthetic construct
  misc_feature 1..9879: note = derived and/or modified CDS sequence (wt) from DENV-1__HM181966__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagtaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgttgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcgacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactcatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatactcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgaccctagatgaaaaaggagtaacccagaatgggagattgataacagctaatcctatagtcactgacaaagaaaaaccagtcaatattgaggcagaaccgccttttggtgagagttacatcgtgataggagcaggtgaaaaagctttgaaactaagctggtttaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatacggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatataaatttcaagctgactccccaaagagactatcagcagccatcgggaaggcatgggaggagggtgtgtgtggaattcgatcagccactcgtctcgagaatattatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagccaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaactacagaccaggatatttcacacaaacggcagggccgtggcatctaggcaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagcaggaaaatgttgatgactggaacactggctgtgttcctccttctcataatggggcaattgacatggaatgatctgatcagattatgcatcatggttggagccaacgcttccgacaggatggggatgggaacgacgtacctagctctgatagccacctttaaaatgagaccaatgtttgctgtcgggctactattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtcctttacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccactatcaataccagcgaccctttttgtgtggtacttttggcagaaaaagaaacagagatctggagtgctatgggatacacctagccctccaaaagtggaaagagcagttcttgatgatggtatctatagaatcatgcagagaggactgttgggcaggtcccaagtaggagtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcaccttcaagacctctgaaggtgaagttggagccattgccctagattttaaacccggcacatctggatctcccatcgtgaacagagaaggaaaaatagtaggtctttatggaaatggagtggtgacaacaagtgggacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggattactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcatgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgctgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaatcaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgagaactacatgggccttgtgcgaatccatcacactggccactggacctctgaccacgctttgggaggggtctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctatatgccaagtgtggtggaaactctggagcaaatgcaaagaaaacatggaggaatgctagtacgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaacggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcccttttgttcacaccacttccaccagctggtaatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagctgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactgattgggaatgagaattatctagattacatgacatcaatgaagagattcaagaacgagggcgatcccgaaggggcactctggtga

SEQ ID NO: 5995 - RNA, 9879 nt, synthetic construct
  misc_feature 1..9879: note = derived and/or modified CDS sequence (wt) from DENV-1__GU131721__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttttagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgctgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaggaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgctggaaaattagtacaccagatttttggaactgcatatggagttttattcagcggtgtttcctggaccatgaaaataggaataggggttttgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatataaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgatatggggtactggatagaaagtgaaaagaacgagacctggaagctggcaagagcctctttcatagaagttaaaacatgtatctggccaaaatcccacactctatggagcaatggagttctggaaagtgaaatgatagttccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcatcatgattttaaaattattgactgactttcaatcacatcagctgtgggctaccttgctatccttgacatttatcaagacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggggctgtactcatgtatcaagggaagagattggaaccgagctgggccagtgttaaaaaagacctgatctcatatggaggaggttggaggcttcaaggatcctggaacacaggagaagaagtgcaggtgattgctgttgaaccggggaaaaaccccaaaaatgtacaaacagcgccgggcacttttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaggcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcggacccactagccctgcgcgagtttaaagagtttgcagcagggagaagaagcgtctcaggtgatttaatattagaaatagggaagcttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacgtccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaactaagcatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcggaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggtcagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcataaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcctaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgaacccgaaggggcactctggtga

SEQ ID NO: 5996 - RNA, 9879 nt, synthetic construct
  misc_feature 1..9879: note = derived and/or modified CDS sequence (wt) from DENV-1__GU131723__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcatagtgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcagttgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagccccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagagttggaaggaaccacaataaagaaggtgatcagtacatctacatgggacagcctttaaataacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcagtggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggctaccaacatacaagtggccataaaccaagtgagaagactaattgggaatgagaattatctagattacatgacatcaatgaagagattcaagaacgagagtgatcccgaaggggcactctggtga

SEQ ID NO: 5997 - RNA, 9879 nt, synthetic construct
  misc_feature 1..9879: note = derived and/or modified CDS sequence (wt) from DENV-1__GU131725__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggactttgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcactgtccacactggagaccagcaccaggtgggaaatgaaagcacagaacatgggacaactgcaactataacacctcaagctcctacgacggaaatacagctgaccgactacggagctcttacattggattgttcacctagaacaggactagactttagtgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaatatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctcttttatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctcagacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgatattaaaattgttgactgactttcaatcatatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaagatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagggtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtagaggcctttccacagagcaacgcagttatccaagatgaggaaagagacattcctgagagatcatggaactcaggctatgagtggattaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttgcatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcagcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctacaaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggttacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaagaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagagtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5998 - RNA, 9879 nt, synthetic construct
  misc_feature 1..9879: note = derived and/or modified CDS sequence (wt) from DENV-1__GU131726__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggatcattttcattttgttaatgctggtaacaccatccatggccatgcgatgcgtgggaataggcagcagggacttcgtggaaggactgtcaggagcaacttgggtagacgtagtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggttagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagcaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcggtcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcgcgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattactccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatcttttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctggctgggccactaatagctggaggcatgctaatagcatgttatgttatatctggaagctcacccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgttcaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtaagagttcccaattacaacatgattatcatggatgaagcacatttcaccgatccatccagtatagcagccagagggtacatctcaacccgagtgggcatgggtgaagcagctgcgatcttcatgacagctactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgttacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaagtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatattggagttcttcctaatggtgctgcttattccagagccagacaggcaacgcactccgcaggacaaccagctggcgtatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggtacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccaattgattgggttccaaccagtcgcaccacctggtcgatccatgcccaccaccaatggatgacaacagaagacatgttgtcagtatggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5999 - RNA, 9879 nt, synthetic construct
  misc_feature 1..9879: note = derived and/or modified CDS sequence (wt) from DENV-1__GU131727__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggatcattttcattttgttaatgctggtaacaccatccatggccatgcgatgcgtgggaataggcagcagggacttcgtggaaggactgtcaggagcaacttgggtagacgtagtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggttagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaacgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgtcggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaaattggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtatcttataacagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagctattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggtatgggtgaagcagctgcgatcttcatgacagccactcctccaggatcagtggaggcctttccacaaagcaatgcagttatccaagatgaggaaagagatattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgttacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattaccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacaggcaacgcactccgcaggacaatcagctggcgtatgtggtgataggtttgttattcatgatactgacagtagcagccaatgagatgggactactggaaactacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgctaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6000 - RNA, 9879 nt, synthetic construct
  misc_feature 1..9879: note = derived and/or modified CDS sequence (wt) from DENV-1__HM631850__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgcccccgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgtattgaagctaaaatatcaaacaccaccactgattcaagatgtccaacacaaggagaagccacactggtggaagaacaagacgcgaactttgtgtgtcgacgaacgtttgtggatagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcaacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatctttgcaggacacttgaaatgtagactaaagatggacaagctgactctaaaagggatgtcatatgttatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagccttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatctgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatcggtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcacccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttgtgggacacacctagccctccagaagtggaaagagcagttcttgatgatggtatctatagaattatgcagagaggactgttgggcaggtcccaagtaggggtaggagttttccaagaaaacgtgtttcacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaatcccaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtatttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtatcaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactatgtcgtcacgacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggagatcagtacatctacatgggacagcctttaaacaacgatgaagatcatgctcactggacagaagcaaaaatgctccttgataatataaacacaccagaagggattattccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaaaggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccactggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattttttataccacccgagaaatgtgacactcttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaataagaaaccgagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggcagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccaattggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6001 - RNA, 9879 nt, synthetic construct
  misc_feature 1..9879: note = derived and/or modified CDS sequence (wt) from DENV-1__KF955446__SS-prME
  source 1..9879: mol_type = other RNA
tctgtgaccatgttccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaaatgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgacttgtgtgagggtaccacagttgttgtggatgaacattgtggaaatcgaggaccatctcttaggaccacaacagtcacaggaaagataattcatgaatggtgttgcagatcttgcacgttaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggtatcatggctgttggaatagtcagcatcctactaagttcactcctcaaaaatgatgtaccgctagctgggccactaatagctggaggcatgctaatagcatgttatgttatatctggaagctcagctgacctatcattagagaaagcggctgaggtctcctgggaagaagaagcagaacactctggtgcctcacacaatatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctacagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccagagcatcacaagaagggcccctaccagagattgaagccgaggtgtttaggaaaagaaacttaacaataatggacctacatccaggatcggggaaaacaagaagatatcttccagccatagtccgtgaggccataaaaaggaagctgcgcacactaattctggctcccacaagggttggcgcttccgaaatggcagaggcgctcaagggaatgccaataaggtaccaaacaacagcagtgaagagtgaacatacaggaaaagagatagttgacctcatgggtcacgccactttcaccatgggcctcctggctcccggaagagttcccaattacaacatggtcatcatggatgaagcacatttcaccgatccatccaggatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaacccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctccctggacagaagcaaaaatgctccttgataatataaacacaccagaagggattatcccagcccttttcgagccagagagagaaaagagtgcagcaatagacggggaatccagactgcggggtgaagcaaggaaaacgtttgtggagctcatgagaagaggagatctacctgtctggctatcctacaaagttgcctcagaaggcttccagtactctgacagaagatggtgctttgacggggaaaggaccaaccaggtgttggaggagaacatggccgtggagatctggccaaaagaaggagaaagaaagaaactccgaccccgctgcctggatgccagaacatactcagaccccctagccctgcgcgagtttaaagagtttccaccagggagaagaagcgtctcaggtgatttaatattagaaatagggaagcttccacaccccttgacgcaaaggccccagaatgccttggccaccctggttatgtcgcacacctccgaacaaggaggaagagcctatagacatgcaatggaagaactgccagccaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagcaacgccactcgccaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgccaaaggatggccaatatcgaagatggacataggagttccacttctcgccttggggtgctattcccaggtgaatccactgacgctgacagcgccggtattgatgctagtgcctcattatcccataattggacctggactccaagcaaaagctactagagaagctcaaaaaaggacagcggccggaataatgaaaaatccaaccgttgatggaatcgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgaccaagtcagaatttaacacctataaaaggagtgggattatggaagtggacagatccgaagccaaagaaggattgaaaagaggagaaacaaccaaacatccagtgtcgagaggaaccgctaaactgaggtggtttgtggagaggacccttgtgaaaccagaagggaaagtcatagacctcggttgtggaagaggtggctggtcatactattgcgctgggctgaagaaagtcacagaagtgaagggatatacaaaaggaggccctggacatgaggacccaatcccaatggggacctatggatggaacctagtaaagctgcgctctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatggcaagtgtggtggaaactctggagcaaatgcaaagaaaacatggaggaatgctagtgcgaaatccactttcaagaaattctactcatgaaatgtattgggtttcatggggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgagggcaagccatcaggatcagcctcatccatggtcaatggcggggtgaaactgctcaccaaaccatgggatggcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgggggaatcttttcaccccgcgaattagagaccccaaacttagccgagagagttctcgactgggtggaaaaatatggcgtcgaaaggctggaaagaatggcaatcagcggagatgactgcctaggagaaccaatttatgataggtttgcgacagccttgacagctcttaatgatatgggaaaagtaagaaaagatataccacaatgggaaccttcaaaaggatggaatgattggcaacaagggcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatggacttccacaggagagacctgagactagccgctaatgctatctggtcagccggtccaggtgattggatcccaaccaggcgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatggcatctatgaagagattcaagaacgagagtgatcccgaaggggcactctggtga

SEQ ID NO: 6002 - RNA, 9879 nt, synthetic construct
  misc_feature 1..9879: note = derived and/or modified CDS sequence (wt) from DENV-1__KF921942__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagttgcaaaccctgctgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacactgcatgggactttggttctataggaggagtgttcacgtctgctggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaaccctatacctaggagtcatggttcaggcggattcaggatgtgtaataaattggaaaggtagagaactcaaatgtggaagtggcatttttgtcaccaatgaagttcacacttggacagagcaatataaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcctccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgtagaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctccgaaatgggagcgaatttccgagccgacagggtgatagacccaagacggtgtctgaaaccggtgatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgatcatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6003 - RNA, 9879 nt, synthetic construct
  misc_feature 1..9879: note = derived and/or modified CDS sequence (wt) from DENV-1__JF937602__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtctggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagtccaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatcccttttttgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtcttgagaacatcatgtggaagcaaatatcaaatgaactgaactacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttgtcagaacaacgttttccctgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtatatctcaacccgagtgggcatgggtgaggcagctgcgatcttcatgacagccactcctccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacagcacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttattattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggcccacaggaaaccaacatacgagagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatctttaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagagactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6004 - RNA, 9879 nt, synthetic construct
  misc_feature 1..9879: note = derived and/or modified CDS sequence (wt) from DENV-1__GU131729__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcttctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgggcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggttagtccacaaacaatggtttttagacctaccactgccttggacctcgggagcttcaacatcacaagagacttggaacagacaagatctgctggtgacatttaagacagctcatgcaaagaagcaggaagtagtcgtgctaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggcttatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagcctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatgatactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggacccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctatgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacatacaggaaaagagatagttgacctaatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcagaaaaacctttgatacagagtaccaaaaaacaaaaaacaacgactgggactacgtcgtcacaacagacatctccgaaatgggagcaaatttccgagccgccagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggacccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtagaaccagaggtagccaacctagatatcattggccagaggatagagaacataaaacatgaacataagtcaacatggcattatgatgaggacaatccatataaaacatgggcctatcatggatcatatgagggcaagccatcaggatcagcctcatccatgggcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacttaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcagcaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattggatcccaaccagccgtaccacctggtcgatccatgcccatcaccaatggatgacgacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6005 - RNA, 9879 nt, synthetic construct
  misc_feature 1..9879: note = derived and/or modified CDS sequence (wt) from DENV-1__GU131730__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagctatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcgggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaggatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaaccctggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagccgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaacaatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagggggtatatctcaacccgagtgggcatgggtgaggcagctgcgatcttcatgacagccactcctccaggatcagtggaggcctttccccagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccccaataaggaaggtgaccagtacatctacatgggacagcctttaaacaacgatgaagatcatgccccctggacagaagcaaaaatgctccttgataatataaacacaccagaaggaattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttctttctatcaggaagggggctagggaaaacatccatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaaccattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcctgatgcggactacatgggccctgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacgacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6006 - RNA, 9879 nt, synthetic construct
  misc_feature 1..9879: note = derived and/or modified CDS sequence (wt) from DENV-1__GU131731__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggatcattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccctttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgttttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactgacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacttcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcgggaaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtagaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggacccacaataaggaaggtgatcagtacatctccatgggacagcctttaaacaccgccgaagatcacgctccctggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttagacaacctggtcatgttgcacaactccgaacaaggaggaagagcctatagacatgcaatggaagaattgccagacaccatagaaacgctgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacaggcaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagacttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggccatgaggacccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaatatgacatctagaatgttgctaaatcgattcacaatggctcacaggaaaccaacatatgaaagagacgtggacctaggcgctggaactagacatgtggctgtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggaattcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttggccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6007 - RNA, 9879 nt, synthetic construct
  misc_feature 1..9879: note = derived and/or modified CDS sequence (wt) from DENV-1__GU131733__SS-prME
  source 1..9879: mol_type = other RNA
tctgtgaccatgttccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgacttgtgtgagggtaccacagttgttgtggatgaacattgtggaaatcgaggaccatctcttaggaccacaacagtcacaggaaagataattcatgaatggtgttgcagatcttgcacgttaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagctgacctatcattagagaaagcggctgaggtctcctgggaagaagaagcagaacactctggtgcctcacacaatatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctacagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccagagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactatgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaatcgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacatagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatctatgaagagattcaagaacgagagtgatcccgaaggggcactctggtga

SEQ ID NO: 6008 - RNA, 9879 nt, synthetic construct
  misc_feature 1..9879: note = derived and/or modified CDS sequence (wt) from DENV-1__GU131734__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacagaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaatgacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactgggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacagactcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgtcggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccactgttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggctacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcatcatgattttaaaattattgattgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgatccaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggcgaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatgggtggaacctagtaaaactgcactccgggaaagacgtattctttataccacccgagaaatgtgacacccttttgtgtgatattggtgagtcctctccaaacccaactatagaggaaggaagaacgctacgcgtccttaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcagcagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 6009 - RNA, 9879 nt, synthetic construct
  misc_feature 1..9879: note = derived and/or modified CDS sequence (wt) from DENV-1__GU131738__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgttgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaggggatcattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaaaaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagactgataacagctaatcctatagtcactgacaaagaaaaaccagtcaacattgaggcagaaccgccctttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaaattggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgttttcctccttctcataatggggcaattgacatggaatgacctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcattctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagatctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgggagatcatggaactcaggatatgagtggatcactgacttcccaggtaaaacagtttggtttggtccaaccatcaaatcaggaaatgacattgccaactgcttaagaaagaatgggaaacgggtaattcaattgagcaggaaaacctttgatacagagtaccaaaaaacaaaaaataacgattgggactatgtcggcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttagacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcttaatggtgctgcttattccagagccagacaggcaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagacttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaacctagtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggctgtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgggcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggaaaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggtaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatacctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6010 - RNA, 9879 nt, synthetic construct
  misc_feature 1..9879: note = derived and/or modified CDS sequence (wt) from DENV-1__JF937604__SS-prME
  source 1..9879: mol_type = other RNA
tctgtgaccatgctccttatgctgatgcctacagccttggcgttccatttgactacacgagggggagagccgcacatgatagtcagtaagcaggaaagaggaaagtcactcttgtttaagacctcagcaggtgtcaacatgtgcacccttatagcgatggatttgggagagttgtgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtagagacttgggccctgagacacccaggattcacggtgatagccctttttctagcacatgccataggaacatccatcacccagaaagggatcattttcattttgttaatgctggtaacaccatccatggccatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctctttggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacactgcatgggactttggttctataggaggagtgttcacgtctgttggaaaattagtacaccagacttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcttacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatctcacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcatatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaaccctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctacagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggattctggaacacaggagaagaagtgcaggtgattgctgttgaaccagggaaaaaccccaaaaatgtacaaacagcaccgggcacctttaagacccctgaaggtgaagttggagccattgccctagacttcaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagctatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgacacagagtaccaaaaaacaaaaaacaacgactgggactacgtcgtcacaacagacatctccgaaatgggagcaaatttccgagccgacagggtgatagacccaagacggtgtctgaaaccggtgatactaaaagatggtccagagcgtgtcattttggcaggaccaatgccagtgactgtggccagtgccgctcagagaagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatacgcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcataactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccttgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagacttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaataccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaagagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtgttctttataccacctgagaaatgtgacacccttttgtgtgatatcggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacaccacaccctttggacaacagagggtgtttaaagagaaagttgacacacgcacaccaaaagcaaaacagggcacagcacaaatcatggaggtgacagccaagtggttgtggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcacagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccaactgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctaagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6011 - RNA, 9879 nt, synthetic construct
  misc_feature 1..9879: note = derived and/or modified CDS sequence (wt) from DENV-1__JF937605__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacattacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagagccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgagcattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatttagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctaaggtctcctgggaagaagaagcagaacactctggtgcctcacacaacatattagtggaagtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccaatgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctgctggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtactttcacaggagagacctgagactagccgctaatgctatctgttcggccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6012 - RNA, 9879 nt, synthetic construct
  misc_feature 1..9879: note = derived and/or modified CDS sequence (wt) from DENV-1__JF937608__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcctgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttctcatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctcctcaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacaacgccgggcacttttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagtttttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttggggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagcggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6013 - RNA, 9879 nt, synthetic construct
  misc_feature 1..9879: note = derived and/or modified CDS sequence (wt) from DENV-1__GU131739__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctctttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggttggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggtagtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacggttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccctggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgccaaccattctccttaaagcaactctgttagcagtttcaggggtgtacccattatcaataccagcgacccttttcgtgtggtacttttggcaaaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtctgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacctatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6014 - RNA, 9879 nt, synthetic construct
  misc_feature 1..9879: note = derived and/or modified CDS sequence (wt) from DENV-1__GU131740__SS-prME
  source 1..9879: mol_type = other RNA
tctgtgaccatgctccttatgttgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgtaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacattatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgttaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagggaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtcctttacatttatcaaaacaacgttttccttgcactatgcgtggaagacaatggccatggtactgtcaattgtatctctcttccccttatgcctgtccacgacctcccaaaaaacaacatggcttccggtgctattgggatctcttggatgcaaaccattaaccatgtttcttatagcagaaaacaaagtctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagtcggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaagacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcgcatttcaccgatccatccagcatagcggccagagggtacatctcaacccgagtgggcatgggtgaagcagctgcgatcttcatgacagctactcccccaggatcaatggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgcggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttagggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacttagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagagaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6015 - RNA, 9879 nt, synthetic construct
  misc_feature 1..9879: note = derived and/or modified CDS sequence (wt) from DENV-1__GU131741__SS-prME
  source 1..9879: mol_type = other RNA
tctgtgaccatgctccttatgctaatgcctacagccttggcgttccatttgactacacgagggggagagccgcacatgatagtcagcaagcaggaaagaggaaagtcacttttgtttaagacctcagcaggtgtcaacatgtgcaccctcatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcctggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagctgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagtttcaacatcacaagagacctggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatacgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctgggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcatacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactagctgtgttcttccttctcataatgggacaattgacatggaatgatctgatcagattatgcatcatggttggagccaacgcttccgataggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagttaggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtctcaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggctataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagtatagcggccagagggtacatctcaacccgagtgggtatgggtgaagcagctgcgatcttcatgacagctactcccccaggatcagtggaggccttcccacagagcaacgcagttatccaagatgaggaaagagacattcctgagagatcatggaactcaggctatgagtggatcactgacttcccgggtaaaacagtttggtttgttccaagcatcaaatcaggaaacgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagcccttttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcatacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacgcaaatagccatgactgacactacaccttttggacaacagagggtgttcaaagagaaagttgatacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaatatgatggggaagagagagaaaaaactaggagagttcggaaaggctaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagatttaagaacgagagtgatcctgaaggggcactctggtga

SEQ ID NO: 6016 - RNA, 9879 nt, synthetic construct
  misc_feature 1..9879: note = derived and/or modified CDS sequence (wt) from DENV-1__GU131743__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtctcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaatatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcggaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatgtcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacggccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgttatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgggaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccactttcaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6017 - RNA, 9879 nt, synthetic construct
  misc_feature 1..9879: note = derived and/or modified CDS sequence (wt) from DENV-1__JN093516__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaattgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagtccaacatgaaaacttgaaatattcagtaatagtcaccgtccacactggagaccagcaccaggtgggaaatgaaagcacagagcatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccattgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactaccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagtcctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggtacactggccgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaactccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaatatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgatcgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtagtgataggtttgttattcatgatactgacagtagcagccaatgagatgggactgctggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgtgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggggaaacaaccaaacacgcagtgtcgagaggaacagctaaactgaggtggtttgtggagaggaatcttgtgaaaccagaagggaaagtcatagaccttggttgtggaagaggtggctggtcatactattgcgctgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggatctaggcgccggaacaagacatgtggcagtggaacctgaggtagccaacctagatatcattggccagaggatagagaacataaaacatgaacataagtcaacatggcattatgatgaggacaacccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgagtgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6018 - RNA, 9879 nt, synthetic construct
  misc_feature 1..9879: note = derived and/or modified CDS sequence (wt) from DENV-1__GU131746__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcttctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggttagtccacaaacaatggtttttagacctaccactgccttggacctcgggagcttcaacatcacaagagacttggaacagacaagatctgctggtgacatttaagacagctcatgcaaagaagcaggaagtagtcgtgctaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcgactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggcttatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagcctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcattacgcatggaagacaatggctatgatactgtcaattgtatctctcttccctttatgcctgtccacgacctcccaaaaaacaacatggcttccggtgttattgggatcccttggatgcaaaccactaaccatgtttcttatagcagaaaataaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctatgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacatacaggaaaagagatagttgacctaatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaaaggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagcgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtagaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacttaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattggatcccaaccagccgtaccacctggtcgatccatgcccatcaccaatggatgacgacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6019 - RNA, 9879 nt, synthetic construct
  misc_feature 1..9879: note = derived and/or modified CDS sequence (wt) from DENV-1__JF937609__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagagaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttctcatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacaacgccgggcacttttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcagaaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacgaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagtttttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttggggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcaaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtggtattatggaagtggacagatccgaagccaaagagggattgaaaagaggagaaacaaccaaacatgcagtgtcgagaggaaccgctaaactgagatggtttgtggagcggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtttttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaggtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6020 - RNA, 9879 nt, synthetic construct
  misc_feature 1..9879: note = derived and/or modified CDS sequence (wt) from DENV-1__KF921949__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtggcactggccccacatgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacattgtaataggagcaggtgaaaaagctttgaaactaagctggttcaggaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtcttgagaacatcatgtggaagcaaatatcaaatgaactgaatcacatcttacttgaaaatgatatgaaattcacagtggtcgtaggagatgttactgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaattggattttgatttgtgtgagggtaccacagttgttgtggatgaacattgtggaaaccgaggaccatctcttaggaccacaacagtcacagggaagataattcatgaatggtgctgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcctccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattaggatcccttggatgcaaaccactaaccatgtttcttatagcagaaaacaaaatctggggaaggagaagttggcccctcaatgaaggaatcatggctgttggaatagtcagcatcctactaagttcactccttaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgccgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagcaaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcatgccactttcaccatgcgcctcctgtctcccgtaagggttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccattagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaagggttgaaaagaggagaaacaaccaaacatgcagtgtcgagaggaaccgctaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgtataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaaaaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcgatatggtacatgtggttgggagcacgctttcttgagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgctcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6021 - RNA, 9879 nt, synthetic construct
  misc_feature 1..9879: note = derived and/or modified CDS sequence (wt) from DENV-1__GU131747__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagttacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgctggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatataaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcagggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgtttttgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccgttctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcagaaaaacctttgatacagagtaccaaaaaacaaaaaacaacgactgggactacgtcgtcacaacagacatctccgaaatgggagcgaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagtgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgtactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacaccacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaacatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6022 - RNA, 9879 nt, synthetic construct
  misc_feature 1..9879: note = derived and/or modified CDS sequence (wt) from DENV-1__GU131748__SS-prME
  source 1..9879: mol_type = other RNA
tctgtgaccatgctctttatgctggtgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttggacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaatttacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaattacagaccaggatattttacacaaacagcagggccgtggcacctaggcaagttggaactggattttgatttgtgtgagggtaccacagttgttgtagatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggcacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcactaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaaccttcgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtaacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagatagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggcctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcaaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6023 - RNA, 9879 nt, synthetic construct
  misc_feature 1..9879: note = derived and/or modified CDS sequence (wt) from DENV-1__GQ868615__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgctccgtcgcactggccccacatgtgggacttggtttggaaacaagaaccgaaacgtggatgtcttctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggttagtccacaaacaatggtttttagacctaccactgccttggacctcgggagcttcaacatcacaagagacttggaacagacaagatctgctggtgacatttaagacagctcatgcaaagaagcaggaagtagtcgtgctaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgtttagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggcttatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggactttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcataatgggacaattgacatggaacgatctgatcagattatgcatcatggttggagccaacgcttctgacaggatggggatgggaacgacgtacctagccctgatggccacttttaaaatgagaccgatgtttgctgtagggctattatttcgcagactaacatccagagaagttcttcttctaacaattggattgagcctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatgatactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctatgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacatacaggaaaagagatagttgacctaatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtagaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacttaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattggatcccaaccagccgtaccacctggtcgatccatgcccatcaccaatggatgacgacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6024 - RNA, 9879 nt, synthetic construct
  misc_feature 1..9879: note = derived and/or modified CDS sequence (wt) from DENV-1__GU131749__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtggagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccaacatcaggtgggaaatgaaagcacagaacatgggacaactgcaactataacacctcaagctcccacgacggaaatacagctgaccgactacggagctcttacattggattgttcacctagaacgggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaatattgaggcagaaccgccttttggtgagagttacatcgtgataggagcaggtgaaaaagctttgaaactaagctggttcaagaaaggaagtagcatagggaaaatgtttgaggcaactgccagaggagcacgaaggatggccatactgggagacaccgcatgggactttggttctataggaggagtgttcacgtctgttggaaaattagtacaccagatttttggaactgcatatagagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatctttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatagaagaggtgatgagatccagatggagtagaaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcaaagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgactttccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaatatttccctgacagccattgcaaaccaggcagccatattgatgggacttgacaaaggatggccaatatcgaagatggacataggagttccacttctcgccttggggtgctattcccaggtgaatccactgacactgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgtgaatccatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggttcgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcaataaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatctagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatttgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgcatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 6025 - RNA, 9879 nt, synthetic construct
  misc_feature 1..9879: note = derived and/or modified CDS sequence (wt) from DENV-1__GU131750__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggtagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagattttaatgaaatggtgttgttgacaatgaaagaaaaatcatggctagtccacaaacaatggtttttagacctaccactgccttggacctcgggagcttcaacgtcacaagagacttggaacagacaagatttgttggtgacatttaagacagctcatgcaaagaagcaggaagtagtcgtactgggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgattacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagaacaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcaatagagaaagcggctgaggtctcctgggaagaagaagcagaacattctggtgcctcacacaacatattagtggaagtccaagacgatggaaccatgaagataaaggatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccatacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgctctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtcctgagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgatgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaattgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtgggattatggaagtggacagatccgaagccaaagagggattaaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgctgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggctgggatacaaggataacagaggatgaccttcagaatgaggccagaattactgacaccatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacctagcgaattagagaccccaaatttagccgagagagttctcgactggctggaaaagtatggcgtcgaaaggctgaaaagaatggcaatcagcggagatgactgcgtagtgaaaccaattgatgataggtttgcaacagccttgacagctctaaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6026 - RNA, 9879 nt, synthetic construct
  misc_feature 1..9879: note = derived and/or modified CDS sequence (wt) from DENV-1__GU131751__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattctgttaatgctggtaacaccatccatggcaatgcgatgtgtgggaataggtagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaattgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggataagctgactctaaaggggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaagtgattaggccacaacccatggaacacaaatactcgtggaaaagttggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcagggacagcaaggcagttcacgctgacatggggtactggatagaaagtgaaaagaacgagacctggaagctggcaagagcctctttcatagaagttaaaacatgtatctggccaaagtcccacactctatggagcaatggtgttctggaaagtgaaatgataattccaaagatctatggaggaccaatatctcagcacaactacagaccaggatatttcacacaaacggcagggccgtggcacctaggcaagctggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacggttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccaaatggagtagaaaaatgctgatgactggaacactggctgtgttcttccttctcataatgggacaactgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctgtctttgacatttatcaaaacaacgttttccttgcactatgcatggaagacaatggccatggtactgtcaattgtatctctcttccccttatgcctgtccacaacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcccataacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacatacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggagacttcaaggatcctggaacacgggagaagaagtgcaggtgattgctgttgaaccaggaaaaaaccccaaaaatgtacaaacagcgccgggcacttttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaagaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagtaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttacacaactccgaacaaggaggaagagcctatagacatgcaatggaggaattgccagacaccatagaaacgttgatgctcctagctttgatagctgtgttaactggtggagtgacgctgttcttcctatcaggaagaggcctagggaaaacatctatcggcctactctgcgtgatggcttcaagcgtactgctatggatggccagtgtggagccccattggatagcggcctccatcatattggagttcttcctgatggtgctgcttattccagagccagacagacaacgcactccgcaggacaaccagctggcatacgtggtgataggtttgttattcatgatactgacagtagcagccaatgagatgggactgctagaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcgacggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatccttttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcactaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtaaagggatatacgaaaggaggacccggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctgaatcgattcacaatggctcacaggaaaccaacgtatgaaagagacgtggacctaggcgccggaacaagacatgtggcagtggaacctgaggtagctaacctagatatcattggccagaggatagagaacataaaacatgaacataagtcaacatggcattatgatgaggacaatccatacaaaacatgggcctaccatggatcatatgaggtcaagccatcaggatcagcctcatccatggttaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcggtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatacatactcagagacatatcaaagattccagggggaaacatgtatgcagatgacacagccggatgggatacaaggataacagaggatgaccttcagaacgaggcaaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaatatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6027 - RNA, 9879 nt, synthetic construct
  misc_feature 1..9879: note = derived and/or modified CDS sequence (wt) from DENV-1__GU131753__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgacagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgactgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttttcgacccaagatgaaaaaggagtaacccagaatgggagactgataacagctaatcctataatcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattgaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggcccaaggaaaaaaaatgattaggccacaacctatggaacacaaatactcgtggaaaagctggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtattggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctaaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaagatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaataatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagcgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccatgaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctctctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagaggtcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgacacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaatacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagagggagaaagaaagaaactacgaccccgctggctggatgccagaacatactcagacccactggccctgcgcgagtttaaagagtttgcagcaggaagaagaagcgtctcaggtgatctaatattagagatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgacggcttcaagcgtactgctatggatggccagtgtggaaccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactagaaaccacaaagaaagacctagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataatcggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccaaacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgacattggtgagtcctctccaaacccaaccatagaagaaggaagaacgttacgcgtcctaaaaatggtggaaccatggcttagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacacccttcggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttttcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagtcgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6028 - RNA, 9879 nt, synthetic construct
  misc_feature 1..9879: note = derived and/or modified CDS sequence (wt) from DENV-1__GU131754__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactagaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgcccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggttcctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggataagctgactctaaaggggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagacaaaccagtcaacattgaggcagaaccgccttttggtgagagctacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgtttacgtctgttggaaaattagtacaccagatttttggaactgcatatggagttttgttcagcggtgtttcttggaccatgaaaataggaataggagttctgctaacatggctaggattaaactcaaggagcacgtccctttcgatgacgtgcattgcagttggcctagtaacattatacctaggagtcatggttcaggcggattcaggatgtgtagttaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgccgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaactgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtgcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcatgtccacaacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgttagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagacgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggcgtaggagttttccaagaaaacgtgttccacacaatgtggcatgtcaccaggggagctgtactcatgtatcaagggaagagactggaaccgagctgggccagtgtcaaaaaggacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacacccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagtaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacgtctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagtcgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatttggttatgttgcacaactccgaacaaggaggaagagcctatagacacgcaatggaggaattgccagacaccatagaaacgttgatgctcctagctttgatagctgtgttaactggtggagtgacgctgttcttcctatcaggaagaggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatacgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaatattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtacgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagctaacctagatatcattggccagaggatagagaacataaaacatgaacataagtcaacatggcattatgatgaggacaatccatacaaaacatgggcctaccatggatcatatgaggtcaagccatcaggatcagcctcatccatggttaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttctgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6029 - RNA, 9879 nt, synthetic construct
  misc_feature 1..9879: note = derived and/or modified CDS sequence (wt) from DENV-1__GU131755__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgctggtgtaatgccacagacacatgggtgacctatggaacatgttcccaaactggtgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaagggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgctgggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgacctgatcagattatgcatcatggttggagccaacgcttccgacaggatggggatgggaacgacgtacctagccctgatggccacttttaaaattagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactgcgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggccttcccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgtttaagaaagaacgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaatatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacactatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacaaacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatccttttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcattgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttaggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgatacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaatcaagtgagaagactaatagggaatgagaattatctagattacatgacatcaatgaagagattcaagaacgagagtgatcccgaaggggcactctggtga

SEQ ID NO: 6030 - RNA, 9879 nt, synthetic construct
  misc_feature 1..9879: note = derived and/or modified CDS sequence (wt) from DENV-1__GU131756__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatctgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacaactgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgcgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattgttgactgattttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatggaaaacgggtgattcagttgagcaggaaaacttttgatacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgcccactggacagaagcaaaaatgctccttgataatataaacacaccagaagggattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggaccacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatctgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6031 - RNA, 9879 nt, synthetic construct
  misc_feature 1..9879: note = derived and/or modified CDS sequence (wt) from DENV-1__GU131758__SS-prME
  source 1..9879: mol_type = other RNA
tctgtgaccatgctccttatgttgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgtaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacattatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgttaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtcctttacatttatcaaaacaacgttttccttgcactatgcgtggaagacaatggccatggtactgtcaattgtatctctcttccccttatgcctgtccacgacctcccaaaaaacaacatggcttccggtgctattgggatctcttggatgcaaaccattaaccatgtttcttatagcagaaaacaaagtctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagtcggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaagacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcgcatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaggacttagggattggccatgcggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttagggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacttagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagagaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6032 - RNA, 9879 nt, synthetic construct
  misc_feature 1..9879: note = derived and/or modified CDS sequence (wt) from DENV-1__GU131759__SS-prME
  source 1..9879: mol_type = other RNA
tctgtgaccatgctccttatgttgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaaaacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacattatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgttaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtcctttacatttatcaaaacaacgttttccttgcactatgcgtggaagacaatggccatggtactgtcaattgtatctctcttccccttatgcctgtccacgacctcccaaaaaacaacatggcttccggtgctattgggatctcttggatgcaaaccattaaccatgtttcttatagcagaaaacaaagtctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagtcggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaagacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcgcatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcccacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgcggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttagggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacttagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagagaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6033 - RNA, 9879 nt, synthetic construct
  misc_feature 1..9879: note = derived and/or modified CDS sequence (wt) from DENV-1__GU131761__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcttctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggttagtccacaaacaatggtttttagacctaccactcccttggacctcgggagcttcaacatcacaagagacttggaacagacaagatctgctggtgacatttaagacagctcatgcaaagaagcaggaagtagtcgtgctaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggcttatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagcctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatgatactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagatacaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctatgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacatacaggaaaagagatagttgacctaatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcccttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacttaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattggatcccaaccagccgtaccacctggtcgatccatgcccatcaccaatggatgacgacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6034 - RNA, 9879 nt, synthetic construct
  misc_feature 1..9879: note = derived and/or modified CDS sequence (wt) from DENV-1__GU131762__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttttgtgaggatacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgttaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggataagctgactctaaaggggatgtcatatgtaatgtgcacaggctcattcaagctagagaaagaagtggccgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacggaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcatgtccctttcgatgacgtgcattgcagttggcctagtaacattatacctaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaactgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttttgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattataacatgattatcatggatgaagcacatttcactgatccatccagcatagcggccagagggtacatctcaacccgagtgggcatgggtgaagcagctgcgatcttcatgacagctactcccccaggatcagtggaggcctttccacagagtaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgcccactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagagtatactcagacccactggccctgcgcgagtttaaagagtttgcagcaggaagaagaagcgtctcaggtgatctaatattagaaatagggaaacttccacaacacttgacgcaaagggcccagaatgccttggacaatctggtcatgttgcacaactccgaacaaggaggaagagcctatagacatgcaatggaggaattgccagacaccatagaaacgttgatgctcctagctttgatagctgtgttaactggtggagtgacgctgttcttcctatcaggaagaggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggctggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacactttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatacacgaaaggaggacctggacatgaggagccaattccaatggcgacctatggatggaacctagtaaaactgcactccgggaaagatgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccttacatgccaagcgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagctaacctagatatcattggccagaggatagagaacataaaacatgaacataagtcaacatggcattatgatgaggacaatccatacaaaacatgggcctaccatggatcatatgaggtcaagccatcaggatcagcctcatccatggttaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggggcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatgggaaagagagagaaaaaactaggagagttcggaaaggcaaaaggaagccgtgcaatatggtacatgtggctgggagcacgctttctagagttcgaagcccttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccaactgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttctgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgccatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagactaattgggaatgagaattatctagattatatgacatcaatgaagagattcaagaacgagagtgatcctgaaggggcactctggtga

SEQ ID NO: 6035 - RNA, 9879 nt, synthetic construct
  misc_feature 1..9879: note = derived and/or modified CDS sequence (wt) from DENV-1__GU131763__SS-prME
  source 1..9879: mol_type = other RNA
tctgtgaccatgctacttatgctgatgcccacagccttggcgttccatctgactacacgagggggagagccacatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggctatgcgatgcgtgggaataggcagtagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacatttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacctagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagcaaatcctatagtcactgacaaagaaaaaccagtcaacattgaggcagaaccgccctttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctcgtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagggcatggaacatttgggaagttgaggactatggatttggaattttcacgacaaatatatggttgaaattgcgtgactcctacactcaagtgtgtgaccaccggctaatgtcagctgccatcaaggacagcaaggcagtccatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgtttcaaaggagaagatgggtgttggtacggtatggaaatcagaccagttaaggaaaaggaagagaatctagtcaaatcaatggtctctgcagggttaggggaagtggacagcttttcactaggactgctatgcatatcaataatgatcgaagaggtgatgagatccagatggagtagaaaaatgttgatggctggaacactggctgtgttcctccttctcataatggggcaattgacatggaatgatctgatcagattatgcatcatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttatcaaaacaacgctttccttacactatgcatggaagacaatggctatggtgctgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctcgctgggccactaatagctggaggcatgctaatagcatgttatgtcatatctggaagctcagccgacttatcattagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcaatttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaaggaaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaagacaagaagatatctcccagccatagtccgtgaggccataaaaagaaagctgcgcacactaattttggctcccacaagagttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagattgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccattggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaactgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaggacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagtaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactctgggaaagacgtattctttacaccacctgagagatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacggccggatgggatacaaggataacggaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacctagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaataaggtttggatagaggaaaacccatggatggaggacaaaacccatgtatccagttggggagatgttccatatctagggaaaagggaagatcagtggtgtggatccctgataggcttaacagcaagggccacctgggcatccaacatacaagtggccataaaccaagtgagaagactaattgggaatgagaattatctagattacatgacatcaatgaagagattcaagaacgagggtgatcccgaaggggcactctggtga

SEQ ID NO: 6036 - RNA, 9879 nt, synthetic construct
  misc_feature 1..9879: note = derived and/or modified CDS sequence (wt) from DENV-1__GU131766__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcatagaacatgggacaactgcaactataacacctcaagctcccacgtcagaaatacagctgaccgactacggagctcttacattggattgctcacccagaacaggattagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttttcgacccaagatgaaaaaggagtaacccagaatgggagactgataacagctaatcctatagtcattgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgtgctacattgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctaaaaaatgatgtgccgctagctgggccactaatagctggaggcatgctaatagcatgttatgtcatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttctcgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttctgaaatggcagaggcgctcaagggaatgccaataaggtaccaaacaacagcagtgaagagtgaacacacaggaaaagagatagttgacctcatgtgccacgccactttcaccatgcgtctcctgtcccccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgatattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggatcatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgatggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctattggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctagcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttctctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatacaaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaaggaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttatcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6037 - RNA, 9879 nt, synthetic construct
  misc_feature 1..9879: note = derived and/or modified CDS sequence (wt) from DENV-1__GU131767__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagtaggtgtcaacatgtgcacccttatagctatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcgggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaacgaactgaaccacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaggatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagccgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagggggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgcccactggacagaagcaaaaatgctccttgataatataaacacaccagaaggaattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttctttctatcaggaagggggctagggaaaacatccatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaaccattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcctgatgcggactacatgggccctgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccagggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacgacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6038 - RNA, 9879 nt, synthetic construct
  misc_feature 1..9879: note = derived and/or modified CDS sequence (wt) from DENV-1__HM181967__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgagcattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatttagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatatggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacaccacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtactttcacaggagagacctgagactagccgctaatgctatctgttcggccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6039 - RNA, 9879 nt, synthetic construct
  misc_feature 1..9879: note = derived and/or modified CDS sequence (wt) from DENV-1__GU131768__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagctatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggatcattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgccaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatatgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaattataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcaattggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgttttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggctagtgtcaaaaaagacctgatctcatatggaggaggttggaggcttcaaggatcctggaacacgggagaagaagtgcaggtgattgctgttgaaccaggaaaaaaccccaaaaatgtacaaacagcgccggggaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggccttcccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaacaacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttagacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacaggcaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccacgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccctgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagacttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggctgtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagcggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6040 - RNA, 9879 nt, synthetic construct
  misc_feature 1..9879: note = derived and/or modified CDS sequence (wt) from DENV-1__GU131770__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgctggtgtaatgccacagacacatgggtgacctatggaacatgttcccaaactggtgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaagggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgctgggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgacctgatcagattatgcatcatggttggagccaacgcttccgacaggatggggatgggaacgacgtacctagccctgatggccacttttaaaattagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactgcgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggccttcccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgtttaagaaagaacgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaatatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacactatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacaaacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatccttttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttaggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgatacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6041 - RNA, 9879 nt, synthetic construct
  misc_feature 1..9879: note = derived and/or modified CDS sequence (wt) from DENV-1__GU131773__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtagagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagcctactaacgtgtgctaagttcaagtgtatgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtattaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagctttttactaggactgctatgcatatcaataatgatcgaagaggtaatgagatccagatggagtaggaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgtgaatccatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 6042 - RNA, 9879 nt, synthetic construct
  misc_feature 1..9879: note = derived and/or modified CDS sequence (wt) from DENV-1__GU131775__SS-prME
  source 1..9879: mol_type = other RNA
tctgtgaccatgcttctcatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggatcattttcattttgttaatgctggtaacaccatccatggccatgcgatgcgtaggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtagtagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccctttggtgagagttacatcgtaataggagcaggtggaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgttttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactgacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagatctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagtcggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttagacaacctggtcatgttgcacaactccgaacaaggaggaagagcctatagacatgcaatggaagaattgccagacaccatagaaacgctgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacaggcaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattatgccataattggacctggactgcaagcaaaagctactagagaagctcaaaaaaggacagcggccggaataatgaaaaatccaaccgtagatggaattgttgcaatagacttggaccctgtggtctatgatgcaaaatttgagaaacaactaggccaaataatgttgttaatattatgcacctcacagatcctcttgatgaggaccacatgggccttatgcgaatccatcacactggccactggacctctgaccacgctttgggagggatctccagggaaattttggaacactacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggctgtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggacgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6043 - RNA, 9879 nt, synthetic construct
  misc_feature 1..9879: note = derived and/or modified CDS sequence (wt) from DENV-1__GU131777__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcctgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttctcatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctcctcaaagcaactctgctagcaatttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacaacgccgggcacttttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagtttttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttggggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagcggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacgtcaatgaagagattcaagaacgagagtgatcccgaaggggcactctggtga

SEQ ID NO: 6044 - RNA, 9879 nt, synthetic construct
  misc_feature 1..9879: note = derived and/or modified CDS sequence (wt) from DENV-1__GU131778__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggactgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaggtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgttggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggactgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccgctaaccatgtttctcatagcagaaaacaaaatctggggaaggaaaagttggcctctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacatacctagccctccagaagtggaaagagcagttcttgatgatggtatctatagaatcatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagatattcctgagagatcatggaactcaggctatgagtggatcactgacttcccgggcaaaacagtttggtttgttccaagtatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttacaaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtgggacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaaagaggcacagcacagatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaggattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaagtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgattcatgcccatcaccaatggatgacaacagaagacatgctgtcagtgtggaatagggtttggatagaggagaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6045 - RNA, 9879 nt, synthetic construct
  misc_feature 1..9879: note = derived and/or modified CDS sequence (wt) from DENV-1__GU131779__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcctgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggtatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttctcatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctcctcaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacaacgccgggcacttttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagtttttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttggggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaattgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagcggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6046 - RNA, 9879 nt, synthetic construct
  misc_feature 1..9879: note = derived and/or modified CDS sequence (wt) from DENV-1__GU131780__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacgggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaagaagtagtcgtactaggatcacaagaaggagcaatgcacactgcgttgaccggagcaacagaaatccaaacgtctggaacgacaacaattttttcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcattattgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattgttccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagttcagccgacctatcactagagaaagcagctgaggtctcctgggaagaagaagcagaacactctggtgcctcacacaacatattagtagaggtccaagatgatggaaccatgaagataaaggatgaagagagagatgacacgctaaccattctccttaaagcaactctgctaacagtctcaggggtgtacccattatcaataccagcgaccctttttgtgtggtacttttggcagaaaaagaaacagagatctggagtgttatgggacacacctagccctccaaaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttgacaataatggacctacatccaggatcggggaaaacaagaagatatcttccagccatagtccgtgaggccataaaaaggaagctgcgcacattaattctggctcctacaagagttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtatatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaatcaggtgttggaggagaacatggacgtggagatctggacaaaagaaggagaaagaaagaaactaagaccccgctggctggatgctagaacgtactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgatgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctaacagccattgcaaaccaggcggctatattgatgggacttgacaaaggatggccaatatcgaagatggacataggagttccacttctcgccttagggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaatagttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctctaggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagcccggagagttcttgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagttgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaatcaagtgagaagactaattgggaatgagaattatctagattacatgacatcaatgaagagattcaagaacgagagtgatcctgaaggtgcactctggtga

SEQ ID NO: 6047 - RNA, 9879 nt, synthetic construct
  misc_feature 1..9879: note = derived and/or modified CDS sequence (wt) from DENV-1__GU131781__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactagaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgcccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggttcctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggataagctgactctaaaggggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagacaaaccagtcaacattgaggcagaaccgccttttggtgagagctacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgtttacgtctgttggaaaattagtacaccagatttttggaactgcatatggagttttgttcagcggtgtttcttggaccatgaaaataggaataggagttctgctaacatggctaggattaaactcaaggagcacgtccctttcgatgacgtgcattgcagttggcctagtaacattatacctaggagtcatggttcaggcggattcaggatgtgtagttaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgccgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaactgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtgcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcatgtccacaacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgttagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagacgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacacccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagtaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacgtctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatttggttatgttgcacaactccgaacaaggaggaagagcctatagacacgcaatggaggaattgccagacaccatagaaacgttgatgctcctagctttgatagctgtgttaactggtggagtgacgctgttcttcctatcaggaagaggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatacgtggtgataggtttgttattcatgatactgacagtagcagccaatgagatgggactgctggaaaccacaaagaaagacttagggattggtcatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaatattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtacgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagctaacctagatatcattggccagaggatagagaacataaaacatgaacataagtcaacatggcattatgatgaggacaatccatacaaaacatgggcctaccatggatcatatgaggtcaagccatcaggatcagcctcatccatggttaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggaacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaggtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttctgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6048 - RNA, 9879 nt, synthetic construct
  misc_feature 1..9879: note = derived and/or modified CDS sequence (wt) from DENV-1__GU131782__SS-prME
  source 1..9879: mol_type = other RNA
tctgtgaccatgctacttatgctgatgcccacagccttggcgttccatctgactacacgagggggagagccacatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggctatgcgatgcgtgggaataggcagtagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagcaaatcctatagtcactgacaaagaaaaaccagtcaacattgaggcagaaccgccctttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctcgtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagggcatggaacatttgggaagttgaggactatggatttggaattttcacgacaaatatatggttgaaattgcgtgactcctacactcaagtgtgtgaccaccggctaatgtcagctgccatcaaggacagcaaggcagtccatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgtttcaaaggagaagatgggtgttggtacggtatggaaatcagaccagttaaggaaaaggaagagaatctagtcaaatcaatggtctctgcagggttaggggaagtggacagcttttcactaggactgctatgcatatcaataatgatcgaagaggtgatgagatccagatggagtagaaaaatgttgatggctggaacactggctgtgttcctccttctcataatggggcaattgacatggaatgatctgatcagattatgcatcatggttggagccaacgcttctgacaggatggggatgggaacgacgtacctagctctgatggccacttttaagatgagaccaatgtttgctgtcgggctattattccgtagactaacatccagagaagttctcctccttacaattggattgagtctagtggcatctgtggagttaccaaattccttggaagagctgggggatggacttgcaatgggcattatgattttaaaattattgactgactttcagccacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctcgctgggccactaatagctggaggcatgctaatagcatgttatgttatatctggaagctcagccgacttatcattagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcaatttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaaggaaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaagacaagaagatatctcccagccatagtccgtgaggccataaaaagaaagctgcgcacactaattttggctcccacaagagttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccattggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaggacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagtaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactctgggaaagacgtattctttacaccacctgagagatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacggccggatgggatacaaggataacggaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcatccaacatacaagtggccataaaccaagtgagaagactaattgggaatgagaattatctagattacatgacatcaatgaagagattcaagaacgagggtgatcccgaaggggcactctggtga

SEQ ID NO: 6049 - RNA, 9879 nt, synthetic construct
  misc_feature 1..9879: note = derived and/or modified CDS sequence (wt) from DENV-1__GU131784__SS-prME
  source 1..9879: mol_type = other RNA
tctgtgaccatgctccttatgttgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgctccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccattacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacaggggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagttaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtatgtggaatacgatcagcaactcgtctcgagaacattatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacctttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcaccatgcgtggaagacaatggccatggtactgtcaattgtatctctcttccccttatgcctgtccacgacctcccaaaaaacaacatggcttccggtgctattgggatctcttggatgcaaaccattaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctgggagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaagacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgcggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcagaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacttagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacacccttcggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccaggagagttctcgactggctggaaaaacatggcgttgaaaggctgaaaagaatggcaatcagcggagatgactgcgtagtaaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6050 - RNA, 9879 nt, synthetic construct
  misc_feature 1..9879: note = derived and/or modified CDS sequence (wt) from DENV-1__JF937612__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcatcaagtgggaaatgaaagcacagaacatgggacaactgcaactataacacctcaagctcctacgacggaaatacagctgaccgactacggagctcttacattggattgttcacctagaacaggactggactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaagccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacgccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcagggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacaacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattcttcttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcaccttcaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccctggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaagacatctatcggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtaaaaccaattgatgataggtttgcaacagccttgacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6051 - RNA, 9879 nt, synthetic construct
  misc_feature 1..9879: note = derived and/or modified CDS sequence (wt) from DENV-1__GU131786__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagctatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcacctgccagaggagcccgaaggatggccatcctgggagccaccgcatgggactttggttctataggaggagtgttcccgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcgggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaggatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagccgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagggggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgcccactggacagaagcaaaaatgctccttgataatataaacacaccagaaggaattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttctttctatcaggaagggggctagggaaaacatccatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaaccattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcctgatgcggactacatgggccctgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccagggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacgacagaagacatgctgtcagtgtggaatagggtttggatagaggaaaacccatggatggaggacaaaacccatatatccagttggggagatgttccatatttaggaaaaagggaagatcaatggtgcggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6052 - RNA, 9879 nt, synthetic construct
  misc_feature 1..9879: note = derived and/or modified CDS sequence (wt) from DENV-1__GU131787__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctctttggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcccgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatggtatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggccatggtactgtcaattgtatctctcttccctttatgcctgtccacgacctcccaaaaaacaacatggcttccggtgttattgggatcccttggatgcaaaccactaaccatgtttcttatagcggaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatccggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtattccacacaatgtggcatgtcaccaggggagctgtactcatgtatcaagggaagagattggaaccgagctgggccagtgtcaaaaaagacctgatctcatatggaggaggttggaggcttcaaggatcctggaacacaggggaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagaccacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccattatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaattatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6053 - RNA, 9879 nt, synthetic construct
  misc_feature 1..9879: note = derived and/or modified CDS sequence (wt) from DENV-1__HM181968__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggatcattttcattttgttaatgctggtaacaccatccatggccatgcgatgcgtgggaataggcagcagggacttcgtggaaggactgtcaggagcaacttgggtagacgtagtactggaacatggaagctgcgtcaccaccatggcgaaagacaaaccaacattggacattgaactcttgaagacggaagtcacaaaccctgccgtcctgcgcaaactgtgcattgaagccaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgccaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggttagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagcaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcggtcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcgcgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtacaacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattactccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatcttttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctggctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgttcaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagctactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgttacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaagtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatattggagttcttcctaatggtgctgcttattccagagccagacaggcaacgcactccgcaggacaatcagctggcgtatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggtacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccaattgattgggttccaaccagtcgcaccacctggtcgatccatgcccaccaccaatggatgacaacagaagacatgttgtcagtatggaatagggtgtggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6054 - RNA, 9879 nt, synthetic construct
  misc_feature 1..9879: note = derived and/or modified CDS sequence (wt) from DENV-1__GU131789__SS-prME
  source 1..9879: mol_type = other RNA
tctgtgacaatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaggaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgattgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttctcatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacaacgccgggcacttttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagtttttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttggggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcaaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagcggaaccttgtgaaaccagaagggaaagtcatagacctcggttgtggaagaggtggctggtcatactactgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgctctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaattttagccgagagagttctcgactggctggaaaaatatggcgtcgaaaggctgaaaagaatggcaatcagcggagatgattgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaatccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6055 - RNA, 9879 nt, synthetic construct
  misc_feature 1..9879: note = derived and/or modified CDS sequence (wt) from DENV-1__GU131790__SS-prME
  source 1..9879: mol_type = other RNA
tctgtgaccatgctccttatgctggtgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttggacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaactcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagctaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtaacactgttcttcctatcaggaaggggcctagggaaaacatctatcggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgtgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatacatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcaaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttagggaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6056 - RNA, 9879 nt, synthetic construct
  misc_feature 1..9879: note = derived and/or modified CDS sequence (wt) from DENV-1__GU131791__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgagcattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatttagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggacccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatattgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtactttcacaggagagacctgagactagccgctaatgctatctgttcggccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6057 - RNA, 9879 nt, synthetic construct
  misc_feature 1..9879: note = derived and/or modified CDS sequence (wt) from DENV-1__GU131792__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagccttgggccctgagacacccaggattcacggtgatagccctttttctagcacatgccataggaacatccatcacccagaaggggatcattttcattttgttaatgctggtaacaccatccatggccatgcgatgcgtgggaataggcagcagggccttcgtggaaggactgtcaggagcaacttgggtagacgtagtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgacctttgtgtgccgccgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgcccgactacggagctcttacattggattgctcacccagaacaggactggactttaatgaaatggtgttgttgacaatgaaagaaaaatcatggttagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgggttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaacgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcccgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggactcaggatgtgtaattaattggaaaggaagagagctcaaatgtggaagtggcatctttggcaccaatgaagttcacacttggacagagcaatacaaatttcaagctgactccccaaagagactatcagcagccatcgggaagccatgggaggagggtgtgtgtggaattcgatcagccactcggctcgagaatatcatgtggaagcaaatatcaaatgaactgaaccacatcttacttgaaaatgacatgaaattcacagtggttgtgggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcccacacccaagtgtgtgaccaccggctaatggcagctgccatcaaggacaggaaggcagttcatgctgacatggggtactggatagaaagtgaaaagaacgagccctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtttcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttggccaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagctattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagatattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgttacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattaccagacaccatagaaacgttgatgctcctagctttgatagctgtgttgactggtggagtgacgctgttcttcctatcaggaaggggcctagggaaaacatctatcggcttactctgcgtgatggcttcaagcgtattgctatggatggccagtgtggagccccattggatagcggcctccatcatactggagttcttcctaatggtgctgcttattccagagccagacaggcaacgcactccgcaggacaatcagctggcgtatgtggtgataggtttgttattcatgatactgacagtagcagccaatgagatgggactactggaaactacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgctaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtagtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6058 - RNA, 9879 nt, synthetic construct
  misc_feature 1..9879: note = derived and/or modified CDS sequence (wt) from DENV-1__HM488256__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgcccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcccgaaggatggccatactgggagcccccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaagcatgggaggagggtgtgtgtggaattcgatcagcaactcgtctcgagaacatcatgtggaagcaaatatcaaatgaactaaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaagacagcaaggcagttcacgctgacatggggtactggatagaaagtgaaaagaacgagacctggaagctggcaagagcctctttcatagaagttaaaacatgtatctgggcaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagcccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtaccctggctgtgttcttccttctcatagtgggccaattgccatggaatgatctgatcagattatgcatcatggttggagccaccgcttccgccaggatggggatgggaacgacgtccctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatgggactgtcagttgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaagaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatttacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagcctcattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaacccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactgggcctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagctggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgactgcgtggtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6059 - RNA, 9879 nt, synthetic construct
  misc_feature 1..9879: note = derived and/or modified CDS sequence (wt) from DENV-1__GU131793__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgctggtgtaatgccacagacacatgggtgacctatggaacatgttcccaaactggtgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccaccacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagctacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgacctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactgcgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagccggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggccttcccacagagcaacgcagttatccaagatgaggaaagagacattcctgagagatcatggaactcaggctatgagtggatcactgatttcccaggtaaaacagtttggtttgttccaagcattaaatcaggaaatgacattgccaactgtttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacactatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacaaacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatccttttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaaaggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttaggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgatacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6060 - RNA, 9879 nt, synthetic construct
  misc_feature 1..9879: note = derived and/or modified CDS sequence (wt) from DENV-1__GU131794__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcaccctcatagcgatggatctgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacaactgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaggtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagctaccaaattccttggaggagctgggggatggacttgcaatgggcattatgattttgaaattgttgactgattttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccttagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcatctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaatcccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtagaaccagaggtagccaacctagatatcattggccagaggatagagaacataaaacatgaacataagtcaacatggcactatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaatatacaagtggccataaaccaagtgagaagactacttgggaatgagaattatctagattacatgacatcaatgaagaggttcaagaatgagagtgatcctgaaggggcactctggtga

SEQ ID NO: 6061 - RNA, 9879 nt, synthetic construct
  misc_feature 1..9879: note = derived and/or modified CDS sequence (wt) from DENV-1__GU131796__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacagaccctgccgtcctgcgtaaactgtgcgttgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaatgacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgtcggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggctacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattactgactgactttcaatcacatcagttgtgggctaccttgctgtccttgacatttatcaaaacaacgtcttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgatccaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggcgaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagggaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatgggtggaacctagtaaaactgcactccgggaaagacgtattctttataccacccgagaaatgtgacacccttttgtgtgatattggtgagtcctctccaaacccaactatagaggaaggaagaacgctacgcgtccttaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaagccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcagcagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgtctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 6062 - RNA, 9879 nt, synthetic construct
  misc_feature 1..9879: note = derived and/or modified CDS sequence (wt) from DENV-1__GU131797__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgctggtgtaatgccacagacacatgggtgacctatggaacatgttcccaaactggtgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgacctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactgcgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctgctaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttctgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatcaagtatagcggccagagggtacatctcaacccgagtgggcatgggtgaagcagctgcaatcttcatgacagccactcccccaggatcagtggaggccttcccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacactatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacaaacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatctggaccctgtggtttatgatgcaaaatttgaaaaacaactaggccaaataatgttgttgatactatgcacatcacagatccttttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctgaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggggtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttaggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgatacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccaactgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6063 - RNA, 9879 nt, synthetic construct
  misc_feature 1..9879: note = derived and/or modified CDS sequence (wt) from DENV-1__GU131801__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtagagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtattaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaacattgaggcagaaccgccttttggtgagagttacatcgggataggagcaggtgaaaaagctttgaaactaagctgggtcaagaaaggaagtagcatagggaaaatggttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatttttgtcaccaatgaagttcacacctggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccacaataaggaaggtgatcagtacatctacatgggacagcctttaaacaacgatgaggatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgtgaatccatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatacacaaaaggaggacctggacatgaggaaccaatcccaatggcgacctatggatggaacctagtaaaactgcactccgggaaagacgtattcttcataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 6064 - RNA, 9879 nt, synthetic construct
  misc_feature 1..9879: note = derived and/or modified CDS sequence (wt) from DENV-1__GU131804__SS-prME
  source 1..9879: mol_type = other RNA
tctgtgaccatgttccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttgtgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgacttgtgtgagggtaccacagttgttgtggatgaacattgtggaaatcgaggaccatctcttaggaccacaacagtcacaggaaagataattcatgaatggtgttgcagatcttgcacgttaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagctgacctatcattagagaaagcggctgaggtctcctgggaagaagaagcagaacactctggtgcctcacacaatatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctacagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccagagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactatgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgcggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaatcgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacatagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccatcggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatctatgaagagattcaagaacgagagtgatcccgaaggggcactctggtga

SEQ ID NO: 6065 - RNA, 9879 nt, synthetic construct
  misc_feature 1..9879: note = derived and/or modified CDS sequence (wt) from DENV-1__GU131805__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacagaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaatgacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgccggaaatacagctgcccgactacggagctcttacattggattgttcacctagaccaggactagactttaatgaaatggtgttgttgccaatgaaagaaaaatcatggctagtccacaaacaatggtttctagacctaccactgccttggacctcgggagcttcaacatcacaagagacttggaacagaaaagatttgctggggacatttaagacagctcatgcaaaggagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccggcttttggtgagagttacatcgtgataggagcaggtgaaaaagctttgaaactaagctgggtcaagaaaggaagcagcatagggaaaatgtttgaggcaactgccagaggagcacgaaggatggccatactgggagacaccgcatgggactttggttctataggaggagtgttcacgtctgtcggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtgggatttttggcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgccatgaaactcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagccctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttccaggaaagataattcatgaatggtgttgcagatcttgtacgctaccacccttacgtttcaaaggagaagatgggtgctggtacggtatggaaatcagcccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaccactgcctgtgttcttccttctcataatgggccaattgccatggaatgatctgatcagattatgcatcatggttggagccaacgcttccgacaggatggggatgggaacgccgtacctagctctgatggctacttttaaaatgagaccaatgtttgctgtaggactattattccgcagactaacatccagagaaggactccttctaacaattggattgagtctagtggcatctgtggagttaccaaattccttggaggagctgggggatggacttgcaatgggcattatgattttaaaattattgactgactttcaatcacatcagttgtgggctaccttgctggccttgacatttatcaaaacaacgttttccttggactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtggctcacacaacatattagtggaggtccaagatgatggaaccatgaagataaaggatgaagagagagatgccacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggttcgttccaagcatcaaatcaggaaatgacattgccaactgcttaagaaagaatgggaaacgggtgatccaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggcgaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagggaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatgggtggaacctagtaaaactgcactccgggaaagacgtattctttataccacccgagaaatgtgacacccttttgtgtgatattggtgagtcctctccaaacccaactatagaggaaggaagaacgctacgcgtccttaagatggtggaaccatggcttagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaagccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcagcagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgtctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 6066 - RNA, 9879 nt, synthetic construct
  misc_feature 1..9879: note = derived and/or modified CDS sequence (wt) from DENV-1__GU131806__SS-prME
  source 1..9879: mol_type = other RNA
tctgtgaccatgttccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaaatgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttttagacctaccactggcttggacctcgggaggctcaacatcacaagagacttggaacagacaagatctggtggtgacatttaagacagctcatggaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctagccaagttggaactggattttgacttgtgtgagggtaccacagttgttgtggatgaacattgtggaaatcgaggaccatctcttaggaccacaacagtcacaggaaagataattcatgaatggtgttgcagatcttgcacgttaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagctgacctatcattagagaaagcggctgaggtctcctgggaagaagaagcagaacactctggtccctcacacaatatattagtggaagtccaagatgatggacccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctacagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatattaggtctttatggaaatggagtagtgacaacaagtggaacctacgtcagtgccatagctcaagccagagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaatcgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggggaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatctatgaagagattcaagaacgagagtgatcccgaaggggcactctggtga

SEQ ID NO: 6067 - RNA, 9879 nt, synthetic construct
  misc_feature 1..9879: note = derived and/or modified CDS sequence (wt) from DENV-1__GU131807__SS-prME
  source 1..9879: mol_type = other RNA
tctgtgaccatgctccttatgctgatgcctacagccttggcgttccatttgactacacgagggggagagccgcacatgattgtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgctggtgtaatgccacagacacatgggtgacctatggaacatgttcccaaactggtgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagccggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacccagaacaggactagactttaatgaaatggtgttggtgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaagggaagcagcatagggaaaatgtttgaggcaactgccagaggagcacgaaggatggccatactgggagacaccgcatgggactttggttctataggaggagtgttcacgtctgttggaaaattagtacaccagatttttggacctgcatatggagttttgttcagcggtgtttcctggcccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaccattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgctgggtcaggggaagtggacagcttttcactaggactcctatgcatatcaataatgatcgaggaggtgatgagatccagatggagtagaaaaatgctgatgactggaacactggctgtgttcttccttctcataatgggacaattgacatggaacgacctgatcagattatgcatcatggttggagccaacgcttccgacaggatggggatgggaacgacgtacctagccctgatggccacttttaaaattagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactgcgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggccttcccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgtttaagaaagaacgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaagaacaaccaggtgttggaggagaatatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacactatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacaaacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatccttttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttaggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgatacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6068 - RNA, 9879 nt, synthetic construct
  misc_feature 1..9879: note = derived and/or modified CDS sequence (wt) from DENV-1__GU131811__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttctgtttaagacctcagcaggtgtcaacatgtgcacccttatagctatggatttgggagagttttgtgaggacacaatgacttacaagtgccctcgaatcactgaggcggaaccagatgacgttgattgttggtgcaatgccacagacacatgggtgacctatggaacatgttcccaaattggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacattggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctgccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacaacaacaatttttgcaggacacttgaaatgtagactaaagatggacaagctgactctaaaagggatgtcatatgtaatgtgcacaggctcattcaagctagagaaagaagtggctgagacccagcatggaaccgttctagtacagattaaatatgaaggaacagatgcaccatgcaagatccctttttcgactcaagatgaaaaaggagtgacccagaatgggagactaataacagctaaccccatagtcactgacaaagagaaaccagtcaacattgaggcagaaccgccttttggtgagagttacatcgtgataggagtaggtgaaaaagctttgaaactaagctggttcaagaaaggaagcagcatagggaaaatgtttgagacaactgccagaggagcacgaaggatggccatactgggagacaccgcatgggactttggttctataggaggagtgttcacgtctgttggaaaattagtacaccagatttttggaactgcatatggagttctgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaacggagttctggaaagtgaaatgataattccgaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttcctcctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccatgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggttcaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaagtagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccggccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagggggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtttgaaaccggtaatactaaaagatggtccagagcgtgtcattttagcaggaccgatgccagtgactgtggccagtgccgcccagaggagaggaagaattggaaggaaccataataaggaaggtgaccagtacatctacatgggacagcctttaaacaacgatgaagatcatgctcactggacagaagcaaaaatgctccttgataatataaacacaccagaaggaattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcttatagacatgcaatggaagaactgccagacaccatagaaacgttgatgctcctagctttgatagctgtgttaactggtggagtgacgctgttcttcctatcaggaagggggctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaaccattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccctgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagctctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6069 - RNA, 9882 nt, synthetic construct
  misc_feature 1..9882: note = derived and/or modified CDS sequence (wt) from DENV-1__JF937615__SS-prME
  source 1..9882: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacagaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaatgacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcaacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactgggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacagactcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgtcggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcaacacaactacagaccaggatatttcacacaaacggcagggccgtggcacctaggcaagttggaactggattttgatttgtgtgagggtaccactgttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggctacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcatcatgattttaaaattattgattgactttcaatcacatcagttgtgggctaccttgctgtccttgacatttatcaaaacaacgttttccttgcactatgcatggaagacaatggccatggtactgtcaattgtatctctcttccccttactgcctgtccacgacttacccaaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgatccaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggcgaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgttcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatgggtggaacctagtaaaactgcactccgggaaagacgtattctttataccacccgagaaatgtgacacccttttgtgtgatattggtgagtcctctccaaacccaactatagaggaaggaagaacgctacgcgtccttaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcagcagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 6070 - RNA, 9879 nt, synthetic construct
  misc_feature 1..9879: note = derived and/or modified CDS sequence (wt) from DENV-1__GU131814__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcctgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttctcatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctcctcaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacaacgccgggcacttttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagtttttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttggggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatctccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagcggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacatgagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacgtcaatgaagagattcaagaacgagagtgatcccgaaggggcactctggtga

SEQ ID NO: 6071 - RNA, 9879 nt, synthetic construct
  misc_feature 1..9879: note = derived and/or modified CDS sequence (wt) from DENV-1__GU131815__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagaattatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcctggaaacagatacaaagagtggaaacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaagactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccattgttactgacaaagaaaaaccagtcaacattgaggcagaaccgccctttggtgagagttacatcacaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacgtggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcgtgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatattttacacaaacagcagggccgtggcacctaggcaaattggaactggattttgatttgtgtgagggtaccacagttgttgtggatgaacattgtggaaatcgaggaccatctcttaggaccacaacagtcacaggaaagataattcatgaatggtgttgcagatcttgcacactaccacccttacgtttcagaggagaagatgggtgctggtacggtatggaaatcagaccagtcaaggaaaaggaagaaaatctagtcaagtcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagttgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggccccttaatgaaggaatcatggctgttggaatagtcagcatcctactaagttcactcctcaaaaatgatgtaccgctagctgggccactaatagctggaggcatgctaatagcatgttatgttatatccggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagcttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggtacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtgtagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcccttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgctggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgctgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgctgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctcctggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcttaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaggctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaagccagaattactgacatcatggaacccgaacatgccctactggctaagtcaatcttcaagttaacctaccaaaataaggtggtaagggtacagagaccagcaaaaaatggaaccgtgatggatgtcatatccaggcgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggttgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6072 - RNA, 9879 nt, synthetic construct
  misc_feature 1..9879: note = derived and/or modified CDS sequence (wt) from DENV-1__GU131818__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagctgcgtcaccaccatggcaaaagacaaaccaacattggacattgaactcttgaagacggaagtcacaaaccctgccgtcctgcgtaaattgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagtccaacatgaaaacttgaaatattcagtaatagtcaccgtccacactggagaccagcaccaggtgggaaatgaaagtacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaagctgactctaaaagggacgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctgatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaactccttggaggagctgggggatggacttgcaatgggcattatgattttaaaattattgactgactttcaatcacatcagttgtgggctaccctgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctacagaattatgcagagaggactgttgggcaggtcccaagtaggagtaggagtttttcaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggcctttacggaaacggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagttcgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaagacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtatatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcttggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttggtactatgcacatcacaaatcctcttgatgcggactacatgggctttgtgtgaatccatcacactagccactggacctctgaccacgctttgggagggatctccaggaaaattttggaacaccacgatagcggtttccatggcaaacattttcagaggaagttatctagcaggagcaagtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataaatcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaatgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccttactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgaggaaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgaaagaaactgcatgcctaggcaagtcatatgcacaaatgtggcagttgatgtacttccacaggagagacctgagactagccgccaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6073 - RNA, 9879 nt, synthetic construct
  misc_feature 1..9879: note = derived and/or modified CDS sequence (wt) from DENV-1__GU131820__SS-prME
  source 1..9879: mol_type = other RNA
tcagtgaccatgctacttatgctgatgcccacagccttggcgttccatctgactacacgagggggagagccacatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggctatgcgatgcgtgggaataggcagtagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagcaaatcctatagtcactgacaaagaaaaaccagtcaacattgaggcagaaccgccctttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctcgtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacacccccgaatgccctgatgatcaaagggcatggaacatttgggaagttgaggactatggatttggaattttcacgacaaatatatggttgaaattgcgtgactcctacactcaagtgtgtgaccaccggctaatgtcagctgccatcaaggacagcaaggcagtccatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgtttcaaaggagaagatgggtgttggtacggtatggaaatcagaccagttaaggaaaaggaagagaatctagtcaaatcaatggtctctgcagggttaggggaagtggacagcttttcactaggactgctatgcatatcaataatgatcgaagaggtgatgagatccagatggagtagaaaaatgttgatggctggaacactggctgtgttcctccttctcataatggggcaattgacatggaatgatctgatcagattatgcatcatggttggagccaacgcttccgacaggatggggatgggaacgacgtacctagctctgatggccacttttaagatgagaccaatgtttgctgtcgggctattattccgtagactaacatccagagaagttctcctccttacaattggattgagtctagtggcatctgtggagttaccaaattccttggaagagctgggggatggacttgcaatgggcattatgattttaaaattattgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctcgctgggccactaatagctggaggcatgctaatagcatgttatgttatatctggaagctcagccgacttatcattagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcaatttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaaggaaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaagacaagaagatatctcccagccatagtccgtgaggccataaaaagaaagctgcgcacactaattttggctcccacaagagttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccattggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcctcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaggacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagtaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactctgggaaagacgtattctttacaccacctgagagatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacggccggatgggatacaaggataacggaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcatccaacatacaagtggccataaaccaagtgagaagactaattgggaatgagaattatctagattacatgacatcaatgaagagattcaagaacgagggtgatcccgaaggggcactctggtga

SEQ ID NO: 6074 - RNA, 9879 nt, synthetic construct
  misc_feature 1..9879: note = derived and/or modified CDS sequence (wt) from DENV-1__HM181970__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcatcgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctaaccgactacggagctcttacattggattgttcacctagaacaggactagactttaatgaaatggtgttgttgacaatgaaggaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatgggaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggtttaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctaggattaaactcaaggagcacgtccctctcgatgacgtgcattgcagtcggcctagtaacgctatacttaggagtcatggttcaggcggattcaggatgcgtaattaactggaaaggtagagaactcaaatgtggaagtggcatttttgttaccaatgaagttcatacctggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgccttcgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaatatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaagacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggccatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggctgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacagggaggaagagcctatagacatgcaatggaagaactgccagacaccatagaaacgttaatgctcctagctttgatagctgtgttaactggtggagtgacgctgtttttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctactcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatccctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgagaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttttgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcggatgacacagccggatgggatacaaggataacagaggatgaccttcagaatgaggccaaaattactgacatcatggaacccgaacacgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcagcaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacagaagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 6075 - RNA, 9879 nt, synthetic construct
  misc_feature 1..9879: note = derived and/or modified CDS sequence (wt) from DENV-1__GU131821__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaattgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagtccaacatgaaaacttgaaatattcagtaatagtcaccgtccacactggagaccagcaccaggtgggaaatgaaagcacagagcatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggtacactggccgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaactccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaatatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgatcgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtagtgataggtttgttattcatgatactgacagtagcagccaatgagatgggactgctggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgtgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggggaaacaaccaaacacgcagtgtcgagaggaacagctaaactgaggtggtttgtggagaggaatcttgtgaaaccagaagggaaagtcatagaccttggttgtggaagaggtggctggtcatactattgcgctgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggatctaggcgccggaacaagacatgtggcagtggaacctgaggtagccaacctagatatcattggccagaggatagagaacataaaacatgaacataagtcaacatggcattatgatgaggacaacccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgagtgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6076 - RNA, 9879 nt, synthetic construct
  misc_feature 1..9879: note = derived and/or modified CDS sequence (wt) from DENV-1__JF937617__SS-prME
  source 1..9879: mol_type = other RNA
tctgtgaccatgctccttatgctgatgcctacagccttggcgttccatttgactacacgagggggagagccgcacatggtagtcagcaagcaggaaagaggaaaatcactcttgttcaagacctcagcaggtgtcaacatgtgcacccttatagcgatggatttgggagagttatgtgaggacacaatgacttacaaatgccctcgaatcactgaagctgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggagatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacctggaacagacaagatttgctggtgacatttaagacagctcatgcaaagaagcaggaagtagtcgtgctaggatcacaagaaggagcaatgcacactgcgttgaccggagcaacagaaatccaaacgtcaggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggattaggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacgtcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcatgggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgatcaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggttgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgacagactttcaatcacatcagctgtgggccaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccatcctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtacaggtgattgctgttgaaccagggaaaaaccccaaaaatgtacaaacagcgccgggcacctttaagacccctgaaggtgaaattggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagtattaaatcaggaaatgacatagccaactgcctaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgaaccggagagggaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacgaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcttatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaaaaaagacttagggattggccatgcggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacccctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagttgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgttgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaactacctagattacatgacatcaatgaagagattcaagaacgagagtgatcccgaaggggcactctggtga

SEQ ID NO: 6077 - RNA, 9879 nt, synthetic construct
  misc_feature 1..9879: note = derived and/or modified CDS sequence (wt) from DENV-1__JF937618__SS-prME
  source 1..9879: mol_type = other RNA
tctgtgacaatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttctcatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatttcatatggaggaggttggaggcttcaaggatcctggaacacaggagaagaagtgcaggtgattgctgttgaaccagggaaaaaccccagaaatgtacaaacaacgccgggcacttttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggacggccagtgtggagccccattggatagcggcctccatcatactggagtttttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttggggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcaaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagcggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggctgtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggcaaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6078 - RNA, 9879 nt, synthetic construct
  misc_feature 1..9879: note = derived and/or modified CDS sequence (wt) from DENV-1__JF937619__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtggagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagctcgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttagttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacagttgacatggaatgatctgatcagattatgcatcatggttggagccaacgcttccgacagaatggggatgggaacgacgtacctagctctgatggtcacttttaaaatgagaccaatgtttgctgtagggcttttattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctctccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctaaaaaatgatgtgccgctagctgggccactaatagctggaggcatgctaatagcatgctatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaaaaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtgatttatgatgcaaaatttgagaaacaactaggccaaataatgttgttgatactatgcacatcacagatcctcttgatgcggactacatgggccctgtgtgaatccatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtagaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagaccactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 6079 - RNA, 9879 nt, synthetic construct
  misc_feature 1..9879: note = derived and/or modified CDS sequence (wt) from DENV-1__GU131827__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagatgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacattgtaataggagcaggtgaaaaagctttgaaactaagctggttcaggaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagtaggcctagtaacactatacctaggagtcatggttcaggcggattcaggatgtgcaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggtaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattaggatcccttggatgcaaaccactaaccatgtttcttatagcagaaaacaaaatctggggaaggagaagttggcccctcaatgaaggaatcatggctgttggaatagtcagcatcttactaagttcactccttaaaaatgatgtaccgctagctgggccactaatagctggaggcatgctaatagcatgttatgttatatctggaagctcagccgacctatcattagagaaagcggctgaggtctcctgggaagaagaagcggaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagcaaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattgtcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaggaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtggcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacccctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgtataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagctcagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccataggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6080 - RNA, 9879 nt, synthetic construct
  misc_feature 1..9879: note = derived and/or modified CDS sequence (wt) from DENV-1__GU131831__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcttctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccactaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggttagtccacaaacaatggtttttagacctaccactaccttggacctcgggagcttcaacatcacaagagacttggaacagacaagatctgctggtgacatttaagacagctcatgcaaagaagcaggaagtagtcgtgctaggatcacaagaaggagcaatgcacactgcgttgaccggagcgacagaaatccaaacgtctggaacgacaacaatttttgcaggacacttgaaatgcagactaaagatggacaaactgactctaaaagggatatcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacagcccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggcttatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagcctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatgatactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggatacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctatgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacatacaggaaaagagatagttgacctaatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtagaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacttaccaaaataaggtggtaagggtacagagaccagcaaaaaatggaaccgtgatggatgttatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattggatcccaaccagccgtaccacctggtcgatccatgcccatcaccaatggatgacgacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6081 - RNA, 9879 nt, synthetic construct
  misc_feature 1..9879: note = derived and/or modified CDS sequence (wt) from DENV-1__EU482789__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacatccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaaatggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttctgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatttacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaagacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaagaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggcttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaagtggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6082 - RNA, 9879 nt, synthetic construct
  misc_feature 1..9879: note = derived and/or modified CDS sequence (wt) from DENV-1__EU482790__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggatcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgtaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccactagctgggccactaatagctggaggcatgctaatagcatgttatgttatatctggaagctcagccgacctatcactagagaaagcagctgaggtctcctgggaagaagaagcagaacactctggcgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtatcaggtgatctaatattagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattgatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgtactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtacccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggatcttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagagtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6083 - RNA, 9879 nt, synthetic construct
  misc_feature 1..9879: note = derived and/or modified CDS sequence (wt) from DENV-1__EU482791__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagacgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacatttttagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6084 - RNA, 9879 nt, synthetic construct
  misc_feature 1..9879: note = derived and/or modified CDS sequence (wt) from DENV-1__EU482792__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgagacggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttttagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggttgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagagagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaaccgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgttgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttctcatagcagaaaacaaaatctggggaaggaaaagttggcccctcaatgaaggaatcatggctgttggagtagtcagtatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctacgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggcaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactacaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaaatcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaatatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtagtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgccaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6085 - RNA, 9879 nt, synthetic construct
  misc_feature 1..9879: note = derived and/or modified CDS sequence (wt) from DENV-1__EU482707__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgctactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattgtgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaagctctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 6086 - RNA, 9879 nt, synthetic construct
  misc_feature 1..9879: note = derived and/or modified CDS sequence (wt) from DENV-1__EU482708__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagtcgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatatcagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6087 - RNA, 9879 nt, synthetic construct
  misc_feature 1..9879: note = derived and/or modified CDS sequence (wt) from DENV-1__EU482709__SS-prME
  source 1..9879: mol_type = other RNA
tctgtgaccatgctccttatgctggtgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttggacttaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcactaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactttatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtttagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaaaggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggatcatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtattcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtagccataaaccaagtgagaagactaattgggaatgagaattatctagattacatgacatcaatgaagagattcaagaacgagagtgatcccgaaggggcactctggtga

SEQ ID NO: 6088 - RNA, 9879 nt, synthetic construct
  misc_feature 1..9879: note = derived and/or modified CDS sequence (wt) from DENV-1__EU482710__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttctgttcagcggtgtttcctggaccatgaaaataggaataggggttctgctgacatggctaggattaaattcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcgtgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaacactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaaccacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgcacgctaccacccttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcttactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggctggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccattgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcccttaaacaacgacgaagatcacgctcactggaccgaagcaaaaatgctccttgataatataaacacaccagaagggattatcccagccctctttgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatatcagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctccttgctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattattgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgcgacacccttttgtgtgatattggtgagtcctctccaaacccaaccatagaagaaggaagaacgttacgcgtcctaaaaatggtggaaccatggctcagagggaaccaattttgcataaaaattctgaatccctacatgccaagtgtggtggaaactctggaacaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtaagaagactaattgggaatgagaattatctagattacatgacatcaatgaagagattcaagaacgagggtgatcccgaaggggcactctggtga

SEQ ID NO: 6089 - RNA, 9879 nt, synthetic construct
  misc_feature 1..9879: note = derived and/or modified CDS sequence (wt) from DENV-1__EU482712__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaacagaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggggtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgatcaccggctaatgtcagctgccatcaaggacagcaaggcagttcacgctgacatggggtactggatagaaagtgaaaagaacgagacctggaagctggcaagagcctccttcatagaagttaaaacatgtatctggccaaagtcccacactctatggagcaatggagttctggaaagtgaaatgataattccaaagaactatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgctcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaactatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacctaacaataatggacctacatccaggatcggggaaaacaagaagatatcttccagccatagtccgtgaggccataaaaaggaagctgcgtacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcctccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaagcttccacaacacttgacgcaaagggcccagaacgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgttgacagcggcggtgttgatgctagtggctcattacgccataattggacctggactgcaagcaaaagctactagagaagctcaaaaaaggacagcggccggaataatgaagaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttacctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatctatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagtttacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggacacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaagagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagttagaagactaattgggaatgagaattatctagattacatgacatcaatgaagagattcaagaacgagagtgatcctgaaggggcactctggtga

SEQ ID NO: 6090 - RNA, 9879 nt, synthetic construct
  misc_feature 1..9879: note = derived and/or modified CDS sequence (wt) from DENV-1__EU249490__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcggatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcctgaagacggaagtcacaaaccctgccgtcctgcgtaaactgtgcattgaagctaaaatatcaaataccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagctacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagccgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacagggaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaagaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtatcgagaggaacagctaaactgaggtggtttgtggagaggaatcttgtgaaaccagaagggaaagtcatagacctcggttgtggaagaggtggctggtcatactactgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcgaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagtggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgatcatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6091 - RNA, 9879 nt, synthetic construct
  misc_feature 1..9879: note = derived and/or modified CDS sequence (wt) from DENV-1__EU249491__SS-prME
  source 1..9879: mol_type = other RNA
tctgtgaccatgctccttatgctgatgcctacagccttggcattccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagccatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagaggggctgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 6092 - RNA, 9879 nt, synthetic construct
  misc_feature 1..9879: note = derived and/or modified CDS sequence (wt) from DENV-1__EU249492__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacgaaactggaaggaaagatagtccaatatgaaaacttgaaatattcagtaatagtcaccgtccacacaggagaccagcaccaggtgggaaatgaaagcacagaacatgggacaactgcaactataacacctcaagctccttcaacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagcgttgaaactaagctggttcaagaaaggaagcagcatagggaaaatgtttgaggcaactgccagaggagcacgaaggatggccatactgggagacaccgcatgggactttggttctataggaggagtgttcacgtctgttggaaagttagtacaccagatttttggaactgcatatggagttttgttcagcggtgtttcctggaccatgaaaataggaataggagttctgctgacatggctaggactaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagacgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaaatgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatctagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaactccttggaggagctgggggatggacttgcaatgggcattatgattttgaaattattgactgactttcaatcacatcagttgtgggctaccttgctgtccatgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacttatcactagagaaagcagctgaggtctcctgggaagaagaagcagaacactctggtgcctcacacaacatattagtggaagtccaagatgatggaaccatgaagataaaggatgaagagagagatgacacgctaaccattctcctcaaagcaactctgctagcagtttcaggggtgtacccattatcaataccagcaaccctttttgtgtggtacttttggcagaaaaagaaacagagatctggagtgttatgggacacacctagccctccagaagtgcaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaggcatcacaggaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggagaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaggctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaagtaggagaggcacgggagcccaaggggaaacactgggagagaaatggaaaagacagctgaaccaactgagtaagtcagaattcaacacttataaaaggagtgggatcatggaagtggacagatccgaggccaaagagggactgaaaagaggagaaacaacaaaacatgcagtgtcgagaggaacagctaaactgaggtggtttgtggagaggaatcttgtgaaaccagaagggaaagtcatagacctcggttgtggaagaggtggctggtcatattattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtgggacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatacaaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacatgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagataccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtggtcctgaaggggcactctggtga

SEQ ID NO: 6093 - RNA, 9879 nt, synthetic construct
  misc_feature 1..9879: note = derived and/or modified CDS sequence (wt) from DENV-1__EU249493__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgctggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgattacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgctgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacattttccttgcactatgcatggaagacaatggccatggtactgtcaattgtatctctcttccccttatgcctgtctacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaaggggatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcggctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctagttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctacgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcccgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaactctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagatactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6094 - RNA, 9879 nt, synthetic construct
  misc_feature 1..9879: note = derived and/or modified CDS sequence (wt) from DENV-1__EU249494__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagctctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgctgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcattgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagccatggttcaggcggattcaggatgtgtaattaattggaaaggtagagagctcaaatgtggaagtggcatttttgtcaccaacgaagttcacacttggacagagcaatacaaatttcaagctgactccccaaagagattatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttctcacaattggattgagtctagtagcatctgtggagttaccaaattccttggaggagctgggggatggacttgcaatgggcattatgattttaaaattactgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcctctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagctagagggtacatctcaacccgagtgggcatgggtgaggcagctgcgatcttcatgacagccactcccccaggatcagtggaggcctttccacagagcaatgcagtcatccaagatgaggaaagagacattcctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatatccgagatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgtacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaagtctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagatgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttataacatgatggggaagagagagaaaaagctaggagagttcggaaaggcaaaagggagtcgtgcaatatggtacatgtggttgggagcacgttttctagagttcgaagctcttggtttcatgaatgaagatcactggttcagtagagagaattcactcagcggagtggaaggagaaggactccacaaactcggatacatactcagagacatatcaaagattccagggggaaatatgtatgcagatgacacagccggatgggatacaaggataacagaggacgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttctgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctctaacatacaagtggccataaaccaagtgagaagactaattgggaatgagaattatctagattgcatgacatcaatgaagagattcaagaacgagggtgatcccgaaggggcactctggtga

SEQ ID NO: 6095 - RNA, 9879 nt, synthetic construct
  misc_feature 1..9879: note = derived and/or modified CDS sequence (wt) from DENV-1__EU249495__SS-prME
  source 1..9879: mol_type = other RNA
tctgtgaccatgctgcttatgctgatgcccacagccttggcgttccatctgactacacgagggggagagccgcatatgatagttaccaagcaggaaagaggaaagtcacttttgtttaagaccacagcaggcgtcaacatgtgcacccttatagcgatggatttgggagagttatgtgaggacacaatgacttacaaatgccctcggatcactgaggcggaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaactcgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6096 - RNA, 9879 nt, synthetic construct
  misc_feature 1..9879: note = derived and/or modified CDS sequence (wt) from DENV-1__EU482794__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtattgtcaattgcatctctcttccccttatgcctgtccacgacctcccaaaaaacaacgtggcttccggtgctattgggatctcttggatgcaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacgacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaactacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtactgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcggccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6097 - RNA, 9879 nt, synthetic construct
  misc_feature 1..9879: note = derived and/or modified CDS sequence (wt) from DENV-1__EU482795__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcggatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcctgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaaccataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaattttttcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagctacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctccttcccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagccgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaagaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtatcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcgaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6098 - RNA, 9879 nt, synthetic construct
  misc_feature 1..9879: note = derived and/or modified CDS sequence (wt) from DENV-1__EU482796__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttctgaaatggcagaggcgctcaagggaatgccaataaggtaccaaacaacagcagtgaagagtgaacacacaggaaaagagatagttgacctcatgtgccacgccactttcaccatgcgtctcctgtcccccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctagcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaaggaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6099 - RNA, 9879 nt, synthetic construct
  misc_feature 1..9879: note = derived and/or modified CDS sequence (wt) from DENV-1__EU482797__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacttcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctacccctgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttttagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacctatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcttttatagaagttaaaacatgtatctggccaaagtcccacactctatggagcaatggagttctggaaagtgaaatgataattccaaaaatctatggaggaccaatatctcagcacaactacagaccaggatatttcacacaaacggcagggccgtggcacctaggcaagttggaactggactttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacgaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagggacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaatactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatgtaccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6100 - RNA, 9879 nt, synthetic construct
  misc_feature 1..9879: note = derived and/or modified CDS sequence (wt) from DENV-1__EU482799__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacttgaagtgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagttactgacaaagaaaaaccagtcaacattgaggcagaaccgccctttggtgagagttacatcataataggagcaggtgaaaaaactttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagtcatggttcaggcggattcaggatgtgtaatcaattggaaaggtagagaactcaaatgtggaagtggcatttttgtcaccaatgaaattcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctaatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccagtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccatcgtgaacagagagggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgtctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggtgaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccggagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6101 - RNA, 9879 nt, synthetic construct
  misc_feature 1..9879: note = derived and/or modified CDS sequence (wt) from DENV-1__EU482800__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggccagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccattgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagagcatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagtaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagttggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactacgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaagatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgccacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaacgagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgctaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccattgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactctgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggttcacaggaaaccaacgtatgaaagagacgtggacctaggcgccggaacaagacatgtggcagtggaacctgaggtagccaacctagatatcattggccagaggatagagaacataaaacatgaacataaatcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttttcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6102 - RNA, 9879 nt, synthetic construct
  misc_feature 1..9879: note = derived and/or modified CDS sequence (wt) from DENV-1__EU482801__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6103 - RNA, 9879 nt, synthetic construct
  misc_feature 1..9879: note = derived and/or modified CDS sequence (wt) from DENV-1__EU482802__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcggatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcctgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaaccataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagctacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcctccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagccgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaagaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtatcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaatcgaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6104 - RNA, 9879 nt, synthetic construct
  misc_feature 1..9879: note = derived and/or modified CDS sequence (wt) from DENV-1__EU482804__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaaggtagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacattcaagacagctcatgcaaagaagcaggaagtagtcgtactaggatcacaagaaggagcaatgcacactgcgttgaccggagcaacagaaatccaaacgtctggaacgacaacaatctttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtgattaattggaaaggtagagaactcaaatgtggaagtggcatttttgtcaccaatgaagttcacacttggacagagcaatacaaatttcaagctgactccccaaagagactatcagcagccatcgggaaggcatgggaggagggcgtgtgtggaatacgatcaacaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataacgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacaaagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacagacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgctgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagaccttggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaatccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcgattctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6105 - RNA, 9879 nt, synthetic construct
  misc_feature 1..9879: note = derived and/or modified CDS sequence (wt) from DENV-1__EU482806__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggatacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctaaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggctgaaattgcgtgactcttacacccaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtatctagctctgatggccacttttaaaatgagaccaatgtttgctgtcgggctattattccgtagactaacatccagagaagttctccttctcacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacattcctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccaatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcattcccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcaccctgcgaattggagattccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggcaacctgggcctctaacatacaagtggccataaaccaagtgagaagactaattgggaatgagaattatctagattacatgacatcaatgaagagattcaagaacgagggtgatcccgaaggggcactctggtga

SEQ ID NO: 6106 - RNA, 9879 nt, synthetic construct
  misc_feature 1..9879: note = derived and/or modified CDS sequence (wt) from DENV-1__EU482807__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttgtagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcgtatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataataggacaattgacatggaatgacttgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacattcatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggagaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtatccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacactatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaagagccaattccaatggcgacctatggatggaacctagtaaaactgcactccgggaaagacgtgttctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcgaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagattatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6107 - RNA, 9879 nt, synthetic construct
  misc_feature 1..9879: note = derived and/or modified CDS sequence (wt) from DENV-1__EU482808__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgtgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggggcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgagccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgctgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatattattgcgccgggctgaagaaagtcacagaagtgaagggatatacgaaaggaggacctggacatgaggagccaattccaatggcgacctatggatggaacctagtaaaactgcactccgggaaagacgtattctttacaccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagagacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6108 - RNA, 9879 nt, synthetic construct
  misc_feature 1..9879: note = derived and/or modified CDS sequence (wt) from DENV-1__EU482809__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgccaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtacagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacactccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagccgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcgggaaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggctagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagatatctccgaaatgggagcaaatttccgggccgatagggtgatagacccaagacggtgtctgaaaccggtaatactaaaagatggtccagagcgtgtcattttagcaggaccgatgccagtgactgtagccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaatcatcactcccatgatgaggcacacaattgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagagaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6109 - RNA, 9879 nt, synthetic construct
  misc_feature 1..9879: note = derived and/or modified CDS sequence (wt) from DENV-1__EU482810__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacgaaactggaaggaaagatagtccaatatgaaaacttgaaatattcagtaatagtcaccgtccacacaggagaccagcaccaggtgggaaatgaaagcacagaacatgggacaactgcaactataacacctcaagctccttcaacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgctggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaacagccagaggagcacgaaggatggccatactgggagacaccgcatgggactttggttctataggaggagtgttcacgtctgttggaaagttagtacaccagatttttggaactgcatatggagttttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagacgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctatacccaaatgtgtgaccaccggttaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatattttacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatctagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaactccttggaggagctgggggatggacttgcaatgggcattatgattttgaaattattgactgactttcaatcacatcagttgtgggctaccttgctgtccatgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacttatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtgcaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaggaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcccacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagctattgcaaaccaggcggccatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaggctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaagtaggagaggcacgggagctcaaggggaaacactgggagagaaatggaaaagacagctgaaccaactgagtaagtcagaattcaacacttataaaaggagtgggatcatggaagtggacagatccgaagccaaagagggactgaaaagaggagaaacaacaaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtgggacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatacaaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggtttcctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacatgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcattggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagataccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtggtcctgaaggggcactctggtga

SEQ ID NO: 6110 - RNA, 9879 nt, synthetic construct
  misc_feature 1..9879: note = derived and/or modified CDS sequence (wt) from DENV-1__EU482811__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtggagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgtatttggccaaaatcccacactctatggagcaatggagttctggaaagtgaaatgataattccaaagatccatggaggaccaatatctcagcataactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatctggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacggacatctccgaaatgggagcaaatttccgggccgacagggtgatagacccaagacggtgtctgaaaccggtaatattaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgcgaatccatcacactggccactggacctctgaccacgctttgggagggatctccaggaaaattttggaacaccacgatagcggtttccatggcaaacatttttagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagctaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctgctggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtctggatagaggaaaacccatggatggaggacaaaacccgtatatccagttgggaagatgttccatatctaggaaaaagggaagatcaatggtgtggatctctgataggcttaactgcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 6111 - RNA, 9879 nt, synthetic construct
  misc_feature 1..9879: note = derived and/or modified CDS sequence (wt) from DENV-1__EU482812__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaaccgcaactataacacctcaagctcctacgacggaaatacagctgaccgactacggagctcttacattggattgctcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagcaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaagtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcttactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagatgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatctgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagctgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6112 - RNA, 9879 nt, synthetic construct
  misc_feature 1..9879: note = derived and/or modified CDS sequence (wt) from DENV-1__EU482813__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatactcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaagaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcaatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagaacaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaagaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctcctgaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggacggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaagaggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattatgccataattggacctggactgcaagcaaaagctactagagaagctcaaaaaaggacagcggccggaataatgaaaaatccaaccgttgatggaattgttgcaatagatttggatcctgtggtttatgatacaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgatttacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggacacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6113 - RNA, 9879 nt, synthetic construct
  misc_feature 1..9879: note = derived and/or modified CDS sequence (wt) from DENV-1__EU482814__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggatttggtttggaaacaagaaccgaaacgtggatgtcctctgaaggcgcttggaaacagatacaaagagtggagacttgggccctgagacacccaggattcacggtgatagcccttttcctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccagtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcaccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctctgggagggatctccaggaaaattttggaacaccacgatagcggtttccatggcaaacattttcagaggaagttacctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6114 - RNA, 9879 nt, synthetic construct
  misc_feature 1..9879: note = derived and/or modified CDS sequence (wt) from DENV-1__EU482815__SS-prME
  source 1..9879: mol_type = other RNA
tctgtgaccatgctccttatgctgatgcctgcagccttggcgttccatttgactacacgagggggagagccgcacatgatagttagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgcgttacaaaactggaaggaaagacagttcaatatgaaaacttgaaatattcagtaacagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatctgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgttttttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtgaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcactcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacccggacatgaggagccaattccaatggcgacctatggatggaacctagtaaaactgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagccgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttgggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6115 - RNA, 9879 nt, synthetic construct
  misc_feature 1..9879: note = derived and/or modified CDS sequence (wt) from DENV-1__EU482816__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgtgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaacgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcaacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccctatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgagccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgatattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatattattgcgccgggctgaagaaagtcacagaagtgaagggatatacgaaaggaggacctggacatgaggagccaattccaatggcgacctatggatggaacctagtaaaactgcactccgggaaagacgtattctttacaccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgacatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6116 - RNA, 9879 nt, synthetic construct
  misc_feature 1..9879: note = derived and/or modified CDS sequence (wt) from DENV-1__EU482821__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcaacagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttattattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6117 - RNA, 9879 nt, synthetic construct
  misc_feature 1..9879: note = derived and/or modified CDS sequence (wt) from DENV-1__EU482822__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgttggagatgtagttgggatcttggctcaaggaaaaaaaatgattaggccacaacccatggaacacaaatactcgtggaaaagctggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctagcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacagtatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtaaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctctttgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6118 - RNA, 9879 nt, synthetic construct
  misc_feature 1..9879: note = derived and/or modified CDS sequence (wt) from DENV-1__EU482476__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgttcaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgctataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatggcatgaaattcacagtggttgtaggagatgtagttgggatcttggctcaaggaaaaaaaatgattaggccacaacctatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcacatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctcttttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccattaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctacagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggatcatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacctgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcaaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatccttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaactagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcattccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacatcgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacataagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgaaagggttctcgactggctggaaaaatatggcgtcgaaaggctgaaaagaatggcaatcagcggagatgactgcgtggtgaaaccaattgatgacaggttcgcaacagccctagcagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtatttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6119 - RNA, 9879 nt, synthetic construct
  misc_feature 1..9879: note = derived and/or modified CDS sequence (wt) from DENV-1__EU482477__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagctttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggcttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattatcttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtgatagtcaccgtccacactggagaccagcaccaggtgggaaatgaaagcacagaacacgggacaactgcaactataacacctcaagctccttcaacggaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagagacttggaacagacaagatttgcttgtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggcagagaactcaaatgtggaagtggcatttttgtcaccaatgaagttcacacttggacagagcaatacaaatttcaagctgactccccaaagagactatcagctgccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctagcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttaatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgttagctgtaggactattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgtattccttgcactatgcatggaagacaatggccatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgaaggaatcatggctgttggaatagtcagcattctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggctccaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaaaacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcagttgagcagaaaaacttttgatacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaaggagcgtctcaggtgatctaatattagaaatagggaaacttccacaacacctgacgcaaagggcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcggctatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccagctgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaatattgtgtcagcagtaaacatgacatccagaatgctgctaaatcgattcacaatggctcacaggaaaccaacgtatgaaagagacgtggacctaggcgccggaacaagacatgtggcagtggaacctgaggtagccaacctagatatcataggccagaggatagagaacataaaacatgaacataagtcaacatggcattatgatgaggacaatccatataaaacatgggcctaccatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctctctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcgatctttaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaggtggccataaaccaagtgagaagactaattgggaatgagaattatctagattacatgacatcaatgaagagattcaagaacgagagtgatcctgaaggggcactctggtga

SEQ ID NO: 6120 - RNA, 9879 nt, synthetic construct
  misc_feature 1..9879: note = derived and/or modified CDS sequence (wt) from DENV-1__EU482478__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacttgatctcatatggaggaggttggaggcttcaaggatcctggaacacaggagaagaagtgcaggtgattgctgttgaaccagggaaaaaccccaaaaacgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctccagtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctctaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagagatagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacacaacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 6121 - RNA, 9879 nt, synthetic construct
  misc_feature 1..9879: note = derived and/or modified CDS sequence (wt) from DENV-1__EU482479__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacgtttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatatgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaagaagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgtcctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtaccgctagctgggccactaatagctggaggcatgctaatagcatgttatgttatatctggaagctcagccgacctatcattagagaaagcggctgaggtctcctgggaagaggaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtgggggtaggagttttccaagaaaacgtgttccacacaatgtggcatgtcaccaggggagctgtactcatgtatcaagggaagagattggaaccgagctgggccagtgtcaaaaaagacctgatctcatacggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgatggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtagtggcttcaagcgttttgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 6122 - RNA, 9879 nt, synthetic construct
  misc_feature 1..9879: note = derived and/or modified CDS sequence (wt) from DENV-1__EU482480__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggcgtcaacatgtgcacccttatagcgatggatttgggagagttttgtgaggacacaatgacttacaagtgccctcggatcactgaggcggaaccagatgacgttgattgttggtgcaatgccacagacacatgggtgacctatggaacatgtacccaaattggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggcaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaattgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaatagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacaggccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatctcgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagtggagtggaaggagaaggactccacaaacttggatacatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagttaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6123 - RNA, 9879 nt, synthetic construct
  misc_feature 1..9879: note = derived and/or modified CDS sequence (wt) from DENV-1__EU482481__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttctgttcagcggtgtttcctggaccatgaaaataggaataggggttctgctgacatggctaggattaaattcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcgtgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaaccacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgcacgctaccacccttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcttactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggctggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccattgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcccttaaacaacgacgaagatcacgctcactggaccgaagcaaaaatgctccttgataatataaacacaccagaagggattatcccagccctctttgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatatcagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctccttgctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattattgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgcgacacccttttgtgtgatattggtgagtcctctccaaacccaaccatagaagaaggaagaacgttacgcgtcctaaaaatggtggaaccatggctcagagggaaccaattttgcataaaaattctgaatccctacatgccaagtgtggtggaaactctggaacaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtaagaagactaattgggaatgagaattatctagattacatgacatcaatgaagagattcaagaacgagggtgatcccgaaggggcactctggtga

SEQ ID NO: 6124 - RNA, 9879 nt, synthetic construct
  misc_feature 1..9879: note = derived and/or modified CDS sequence (wt) from DENV-1__EU482482__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaaccggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatatttcacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagttagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggccactaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatctgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6125 - RNA, 9879 nt, synthetic construct
  misc_feature 1..9879: note = derived and/or modified CDS sequence (wt) from DENV-1__EU482485__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttctcaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaattacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctattaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctctctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagcttatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgacctccagaatgaggccagaattactgacatcatggaacctgaacatgccctactggctaagtcaatcttcaagctaacctaccaaaataaggtggtaagggtacagagaccaacaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccagttgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6126 - RNA, 9879 nt, synthetic construct
  misc_feature 1..9879: note = derived and/or modified CDS sequence (wt) from DENV-1__EU482486__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggtttattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatccgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtagaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattataacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacttttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcctagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgacaatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagaccttggttgtggaagaggtggctggtcatactattgcgctgggctgaagaaagtcacagaagtgaagggatacacaaaaggaggacccggacatgaagaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagattagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgatagtgatcccgaaggggcactctggtga

SEQ ID NO: 6127 - RNA, 9879 nt, synthetic construct
  misc_feature 1..9879: note = derived and/or modified CDS sequence (wt) from DENV-1__EU482487__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacgtttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgtcctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgcaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtggggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaggaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcagggaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgatggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttttgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgcggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 6128 - RNA, 9879 nt, synthetic construct
  misc_feature 1..9879: note = derived and/or modified CDS sequence (wt) from DENV-1__EU482488__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagctttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgccaagttcaagtgtgtgacaaaactggaaggaaagatagttcaatatgaaaacttgaaatattcagtaatagtcaccgtccacacaggagaccagcaccaggtggggaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtacagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacattttacttgaaaatgacatgaaactcacagtggttgtaggagatgttgctggaatcttggctcaaggaaaaaaaatgattaggccacaacccatggaatacaaatactcatggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgacttccaatcacatcagttgtgggctaccttgctgtccttgacatttatcagaacaacgttttccttgcactatgcatggaagacaatggcaatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactgagttcactcctcaaaaatgatgtgccgctagctgggccactaatagctggaggcatgctaatagcatgttatgttatatctggaagctcagccgatctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagatatctccgaaatgggagcaaatttccgggccgacagggtgatagacccaagacggtgtctgaaaccggtaatactaaaagatggtccagagcgtgtcattttagcaggaccgatgccagtgactgtagccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagttcaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccggcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggttaagccgtcagggtcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttgggaagatgttccatatttgggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6129 - RNA, 9879 nt, synthetic construct
  misc_feature 1..9879: note = derived and/or modified CDS sequence (wt) from DENV-1__EU482489__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacgttgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagttacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctattaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcagtggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6130 - RNA, 9879 nt, synthetic construct
  misc_feature 1..9879: note = derived and/or modified CDS sequence (wt) from DENV-1__EU482490__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttataaatgccctcgaatcactgaaactgaaccagatgacgttgattgttggtgtaatgccacagacacatgggtgacctatggaacatgttcccaaactggcgagcaccggcgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacagaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcacaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaattataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactactatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaagatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacttacatccaggatcggggaaaacaagaagatatcttccagccatagtccgtgaggccataaaaaggaagctgcgcacactaattctggctcccacgagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatatgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttgaacactttcaccaacatggaagcccagctgataagacaaatggagtctgagggaatcttctcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6131 - RNA, 9879 nt, synthetic construct
  misc_feature 1..9879: note = derived and/or modified CDS sequence (wt) from DENV-1__EU482491__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggcgtcaacatgtgcacccttatagcgatggatttgggagagttttgtgaggacacaatgacttacaagtgccctcggatcactgaggcggaaccagatgacgttgattgttggtgcaatgccacagacacatgggtgacctatggaacatgtacccaaattggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggcaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaattgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaatagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaagagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacaggccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaagggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactactattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacactgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatctcgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatacatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagttaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6132 - RNA, 9879 nt, synthetic construct
  misc_feature 1..9879: note = derived and/or modified CDS sequence (wt) from DENV-1__EU482493__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcatagtgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcagttgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagttgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataagataccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaagaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6133 - RNA, 9879 nt, synthetic construct
  misc_feature 1..9879: note = derived and/or modified CDS sequence (wt) from DENV-1__EU482494__SS-prME
  source 1..9879: mol_type = other RNA
tctgtgaccatgctccttatgctgatgcctacagccttggcgttccatctgactacacgagggggagagccgcacatgatagtcagcaagcaggaaagaggaaagtcactcttgtttaagacctcagcaggtgttaacatgtgcacccttatagcgatggatttgggagagttatgtgaggacacaataacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggcaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacaccccaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggtacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacggcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtagaaactctggagcaaatgcaaagaaaacatgggggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6134 - RNA, 9879 nt, synthetic construct
  misc_feature 1..9879: note = derived and/or modified CDS sequence (wt) from DENV-1__EU482495__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggtttattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatccgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagctaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtagaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccggggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattataacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgacaatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacatagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagaccttggttgtggaagaggtggctggtcatactattgcgctgggctgaagaaagtcacagaagtgaagggatacacaaaaggaggacccggacatgaagaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcacttagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagattagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgatagtgatcccgaaggggcactctggtga

SEQ ID NO: 6135 - RNA, 9879 nt, synthetic construct
  misc_feature 1..9879: note = derived and/or modified CDS sequence (wt) from DENV-1__EU482496__SS-prME
  source 1..9879: mol_type = other RNA
tctgtgaccatgctccttatgctgatgcctacagccttggcgttccatttgactacacgagggggggagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctagtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcatttaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaatcgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatggcaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacattgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactaagcaagtcagaatttaacacctataaaaggagtgggatcatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccgaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatgggggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggatctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatcccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6136 - RNA, 9879 nt, synthetic construct
  misc_feature 1..9879: note = derived and/or modified CDS sequence (wt) from DENV-1__EU482497__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagggacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacattatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcttgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacacggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacaccatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6137 - RNA, 9879 nt, synthetic construct
  misc_feature 1..9879: note = derived and/or modified CDS sequence (wt) from DENV-1__EU482499__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacgtttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgtcctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaggaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgatggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttttgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccgagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttgggaagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 6138 - RNA, 9879 nt, synthetic construct
  misc_feature 1..9879: note = derived and/or modified CDS sequence (wt) from DENV-1__EU482500__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacttgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctctaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaaaatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagagatagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacacaacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaatgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaagccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgactggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 6139 - RNA, 9879 nt, synthetic construct
  misc_feature 1..9879: note = derived and/or modified CDS sequence (wt) from DENV-1__EU482501__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgttggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggctatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagacgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgctctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgtcccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataacataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtgctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggctgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacctagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatacttaggaaaaagggaagaccaatggtgtggatccctgataggcttaacagcaagggccacctgggccaccaatatacaagtggccataaaccaagtgagaagactaattgggaatgagaattatctagattacatgacatcaatgaagagattcaagaacgagagtgatcccgaaggggcactctggtga

SEQ ID NO: 6140 - RNA, 9879 nt, synthetic construct
  misc_feature 1..9879: note = derived and/or modified CDS sequence (wt) from DENV-1__EU482504__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctctttggaaaagggagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctctcgatgacgtgcattgcagttggcctagtaacactatacctaggagtcatggttcaggcggattcaggatgtgtaataaattggaaaggtagagaactcaaatgtggaagtggcattttcgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccatcggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggtcaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaagcgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatatcagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccattatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggctggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcacaaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccataaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcatcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcaatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6141 - RNA, 9879 nt, synthetic construct
  misc_feature 1..9879: note = derived and/or modified CDS sequence (wt) from DENV-1__EU482505__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttaggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaagcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctaactctaaaagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacatcagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtgattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaacacaaatactcatggaaaagctggggaaaggctaaaatcataggggcagatgtgcagaatgccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcattatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctcctgaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggcccccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggtatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcagggaggggcctagggaaaacatctatcggcctactctgtgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatacaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtctccatggcaaacatttttagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttctgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcaacagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagattgatcctgaaggggcactctggtga

SEQ ID NO: 6142 - RNA, 9879 nt, synthetic construct
  misc_feature 1..9879: note = derived and/or modified CDS sequence (wt) from DENV-1__EU482506__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagatacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaatagggattctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatactggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactatgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaattatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaagactgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 6143 - RNA, 9879 nt, synthetic construct
  misc_feature 1..9879: note = derived and/or modified CDS sequence (wt) from DENV-1__EU482509__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcatcttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgctggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgatatggggtactggatagaaagtgaaaagaacgagacctggaagctggcaagagcctctttcatagaagttaaaacatgtatctggccaaaatcccacactctatggagcaatggagttctggaaagtgaaatgatagttccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccggggaaaaaccccaaaaatgtacaaacagcgccgggcacttttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcgggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaggcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctgcgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggtcagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcctaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccatcagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgaacccgaaggggcactctggtga

SEQ ID NO: 6144 - RNA, 9879 nt, synthetic construct
  misc_feature 1..9879: note = derived and/or modified CDS sequence (wt) from DENV-1__EU482510__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgtcaacatgtgcaccctcatagcgatggatttaggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacctgggccctgagacacccaggattcacggtgatagccctttttctagcacatgctataggaacatccatcacccagaaagggattattttcattctgttaatgctagtgacaccttccatggccatgcgatgcgtgggaataggcagcagggacttcgtggaaggactgtcaggagcaacttgggtagatgtggtactggaacatggaagctgcgtcaccaccatggcaaaagacaaaccaacattggacattgaactcttgaggacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttctagtgcagattaaatacgaaggaacagatgcaccatgcaagatccccttttcgacccaagatggaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtcactttcgatgacgtgcattgcagttggtctagtaacactatacctaggagtcatggttcaggcggattcaggatgtgtaattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaatcacatcttacttgaaaatgacatgaaattcacagtagttgtaggagatgttgttgggatcttggctcagggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagttggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggtcggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgttaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggtgtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggtacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacattaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgatcatcatggatgaagcacatttcaccgatccatccagcatagcggccagaggatacatctcaactcgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaagcgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtttgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtttcaggtgatttaatattagaaatagggaaactcccacaacacttgacgcaaagggcccagaatgccttggacaacctggtcatgttgcacaactccgaacaaggaggaagagcctatagacatgcaatggaagaactcccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatagccagtgtggagccccattggatagcggcctccatcatactggagttcttcttgatggtgctgcttattccagagccagacagacaacgcacaccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaattgagcaagtcagaatttaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaatatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacgaggcactgcacaaatcatggaggtgacagccagatggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagtagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaatatggcgtcgaaaggctaaaaagaatggcaatcagcggagatgactgcgtggtgaaaccaattgatgacaggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 6145 - RNA, 9879 nt, synthetic construct
  misc_feature 1..9879: note = derived and/or modified CDS sequence (wt) from DENV-1__EU482511__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaatcctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatgtctcagcacaactacaggccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccatttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6146 - RNA, 9879 nt, synthetic construct
  misc_feature 1..9879: note = derived and/or modified CDS sequence (wt) from DENV-1__EU482513__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggctactggacctctgaccacgctttgggagggatctccaggaaaattttggaacaccacgatagcggtttccatggcaaacattttcagagggagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6147 - RNA, 9879 nt, synthetic construct
  misc_feature 1..9879: note = derived and/or modified CDS sequence (wt) from DENV-1__EU482515__SS-prME
  source 1..9879: mol_type = other RNA
tctgtgaccacgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaatcctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatgtctcagcacaactacaggccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcaaaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggctaccaacatacaagtggccataaaccaagtgagaagactaattgggaatgagaattatctagattacatgacatcaatgaagagattcaagaacgagagtgatcccgaaggggcactctggtga

SEQ ID NO: 6148 - RNA, 9879 nt, synthetic construct
  misc_feature 1..9879: note = derived and/or modified CDS sequence (wt) from DENV-1__EU482516__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtagcatctgtggagttaccaaattccttggaggagctgggggatggacttgcaatgggcattatgattttaaaattattgactgattttcaatcacatcagctgtgggccaccttgctgtccttgacatttatcaaaacaacgttgtccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaaggtatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctatcggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccactcctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttattgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6149 - RNA, 9879 nt, synthetic construct
  misc_feature 1..9879: note = derived and/or modified CDS sequence (wt) from DENV-1__EU482517__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaacacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagcggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccttacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggactctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6150 - RNA, 9879 nt, synthetic construct
  misc_feature 1..9879: note = derived and/or modified CDS sequence (wt) from DENV-1__EU482519__SS-prME
  source 1..9879: mol_type = other RNA
tctgtgaccatgctacttatgctgatgcccacagccttggcgttccacctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatggccctttttctagcacatgccataggaacgtccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaaggtagttcaatatgaaaacttgaaatattcagtaatagtcaccgtccacactggagaccagcaccaggtgggaaatgaaagcacagaacacgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatctggccaaaatcccacactctatggagcaatggagttctggaaagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgaccagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgatcttaaaattattgactgactttcagtcgcatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactccttaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggttcaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagactcctgaaggtgaagttggagccattgccctagattttaaacccggcacatctggatctcccattgtgaacagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttacacaactccgaacaaggaggaagagcctatagacatgcaatggaagaactgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcagatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccataggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6151 - RNA, 9879 nt, synthetic construct
  misc_feature 1..9879: note = derived and/or modified CDS sequence (wt) from DENV-1__EU482520__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgagagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatggacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaatactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcgaactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6152 - RNA, 9879 nt, synthetic construct
  misc_feature 1..9879: note = derived and/or modified CDS sequence (wt) from DENV-1__EU482521__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgaggcacccaggattcacggtgatagccctctttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcttaataacgtgtgctaagttcaagtgtgtgacaaaactggaaggaaagatagttcaatatgaaaacttgaaatattcagtaatagttaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacgtttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggagaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggagaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccatactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaagatgctgatgactggaacactggctgtgttcctccttctcataatgggacaattgacatggaatgatctgatcagactatgcatcatggttggagccaacgcttccgacaggatggggatgggaacgacgtacctagctctgatggccacttttaaaatgagaccgatgtttgctgtagggctattatttcgcagactaacatccagagaagttcttctcctaacaattggattgagtctagtggcatctgtggagttaccaaattccttggaggagctgggggatggacttgcaatgggcattatgattttaaaattattgactgactttcaatcacatcagctgtgggctaccttgctgtccttgacattcatcaaaacaacgttttccttgcactatgcatggaagacaatggctatggtgctgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacatttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccttagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaaaggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctacgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaataaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagattagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6153 - RNA, 9879 nt, synthetic construct
  misc_feature 1..9879: note = derived and/or modified CDS sequence (wt) from DENV-1__EU482523__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatacaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6154 - RNA, 9879 nt, synthetic construct
  misc_feature 1..9879: note = derived and/or modified CDS sequence (wt) from DENV-1__EU482525__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcactgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccttttcgatgacgtgcattgcagtcggcctagtaacgctatacttaggagtcatggttcaggcagattcaggatgtgtaattaactggaaaggtagagaactcaaatgtggaagtggcatttttgtcaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttttggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcggctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcatcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagactgatcccgaaggggcactctggtga

SEQ ID NO: 6155 - RNA, 9879 nt, synthetic construct
  misc_feature 1..9879: note = derived and/or modified CDS sequence (wt) from DENV-1__EU482526__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggatacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccacaaacaatggtttctagacctaccactgccctggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtagatgaacattgtggaaatcgaggaccatctcttagaaccacaacagtcacaggaaagataattcatgaatggtgttgcagatcttgcacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttctcacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagccgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatagtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacatccctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccaatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacactgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggattcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggcaacctgggcctctaacatacaagtggccataaaccaagtgagaagactaattgggaatgagaattatctagattacatgacatcaatgaagagattcaagaacgagggtgatcccgaaggggcactctggtga

SEQ ID NO: 6156 - RNA, 9879 nt, synthetic construct
  misc_feature 1..9879: note = derived and/or modified CDS sequence (wt) from DENV-1__EU482527__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaaccgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatggaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggattatggatttggaattttcacgacaaacatatggctgaaattgcgtgattcctacacccaagtgtgtgaccaccggctaatgtcagctgccatcaaggacagcaaggcagttcacgccgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatttgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaggggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgcccactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggtcagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaggttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgagcatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 6157 - RNA, 9879 nt, synthetic construct
  misc_feature 1..9879: note = derived and/or modified CDS sequence (wt) from DENV-1__EU482528__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaactgagacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagccatggttcaggcggattcgggatgtgtaattaattggaaaggtagagaactcaaatgtggaagtggcatttttgtcaccaatgaagttcacacttggacagagcaatacaaatttcaagctgactccccaaagagattatcagcagccatcgggaaggcatgggaggagggtgtgtgtggaatacgatcagcaactcgtctcgagaacatcatgtggaagcaaatatcaaatgaactgaaccacatcttacttgaaaatgatatgaaattcacagtggttgtaggagatgttgctggaatcttggctcaaggaaaaaaaatgattaggccacaacccatggaatacaaacactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttttggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtctggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgttagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctattcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatacacgaaaggaggacctggacatgaggagccaattccaatggcgacttatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccggggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggaggggaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6158 - RNA, 9879 nt, synthetic construct
  misc_feature 1..9879: note = derived and/or modified CDS sequence (wt) from DENV-1__EU482529__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacattacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 6159 - RNA, 9879 nt, synthetic construct
  misc_feature 1..9879: note = derived and/or modified CDS sequence (wt) from DENV-1__EU482531__SS-prME
  source 1..9879: mol_type = other RNA
tctgtgaccatgctgcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttaacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctaatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttgcgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaatagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggctataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6160 - RNA, 9879 nt, synthetic construct
  misc_feature 1..9879: note = derived and/or modified CDS sequence (wt) from DENV-1__EU482532__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacattcaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggcgtgtgtggaatacgatcaacaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagatcaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacaaagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgctgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagaccttggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaatccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcgattctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6161 - RNA, 9879 nt, synthetic construct
  misc_feature 1..9879: note = derived and/or modified CDS sequence (wt) from DENV-1__EU482533__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagcccttttcctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtaatcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaatgccaccttcatcatcgacggcccaaacaccccagaatgccctgacgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagctctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccactcctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggcattctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgacatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaactcacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 6162 - RNA, 9879 nt, synthetic construct
  misc_feature 1..9879: note = derived and/or modified CDS sequence (wt) from DENV-1__EU482534__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagttactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttgtcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgacgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgatcgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacattttaccgatccatccagcatagcggccagagggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgacctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagagactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6163 - RNA, 9879 nt, synthetic construct
  misc_feature 1..9879: note = derived and/or modified CDS sequence (wt) from DENV-1__EU482535__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttctcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagttggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacactaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaagaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaagtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatagacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgcggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttaattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 6164 - RNA, 9879 nt, synthetic construct
  misc_feature 1..9879: note = derived and/or modified CDS sequence (wt) from DENV-1__EU482536__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggaaacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaataccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggtttaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacatgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagaggctggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgagggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctttatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggctttctcattaatgaaatctctaggaggaggtagaagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggttaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6165 - RNA, 9879 nt, synthetic construct
  misc_feature 1..9879: note = derived and/or modified CDS sequence (wt) from DENV-1__EU482537__SS-prME
  source 1..9879: mol_type = other RNA
tctgtgaccatgctgcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctgaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcatctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagagggctgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaatagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtttgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagctaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga
